US011110162B2

(12) United States Patent
Tauber et al.

(10) Patent No.: US 11,110,162 B2
(45) Date of Patent: Sep. 7, 2021

(54) RECOMBINANT ZIKA VACCINES

(71) Applicant: Themis Bioscience GmbH, Vienna (AT)

(72) Inventors: Erich Tauber, Muckendorf (AT); Sabrina Schrauf, Mörbisch am See (AT); Matthias Müllner, Pixendorf (AT); Katrin Ramsauer, Vienna (AT); Angelika Irmler, Vienna (AT); Patrick Csar, Königstetten (AT)

(73) Assignee: THEMIS BIOSCIENCE GMBH, Vienna (AT)

( * ) Notice: Subject to any disclaimer, the term of this patent is extended or adjusted under 35 U.S.C. 154(b) by 0 days.

(21) Appl. No.: 16/063,239

(22) PCT Filed: Dec. 23, 2016

(86) PCT No.: PCT/EP2016/082659
§ 371 (c)(1),
(2) Date: Jun. 15, 2018

(87) PCT Pub. No.: WO2017/109222
PCT Pub. Date: Jun. 29, 2017

(65) Prior Publication Data
US 2019/0083601 A1  Mar. 21, 2019

(30) Foreign Application Priority Data

Dec. 23, 2015 (EP) ..................... 15202480
Mar. 29, 2016 (EP) ..................... 16162688

(51) Int. Cl.
| *A61K 39/12* | (2006.01) |
| *A61P 31/14* | (2006.01) |
| *A61K 39/165* | (2006.01) |
| *C12N 7/00* | (2006.01) |
| *C12N 15/86* | (2006.01) |
| *B01D 15/38* | (2006.01) |
| *B01J 20/282* | (2006.01) |
| *C12N 7/02* | (2006.01) |
| *B01D 15/36* | (2006.01) |

(52) U.S. Cl.
CPC ............ *A61K 39/12* (2013.01); *A61K 39/165* (2013.01); *A61P 31/14* (2018.01); *B01D 15/3804* (2013.01); *B01J 20/282* (2013.01); *C12N 7/00* (2013.01); *C12N 7/02* (2013.01); *C12N 15/86* (2013.01); *B01D 15/361* (2013.01); *C12N 2760/00034* (2013.01); *C12N 2760/00051* (2013.01); *C12N 2760/18051* (2013.01); *C12N 2760/18434* (2013.01); *C12N 2760/18443* (2013.01); *C12N 2770/24121* (2013.01); *C12N 2770/24122* (2013.01); *C12N 2770/24134* (2013.01); *C12N 2770/24151* (2013.01); *C12N 2800/22* (2013.01); *C12N 2840/105* (2013.01); *Y02A 50/30* (2018.01)

(58) Field of Classification Search
None
See application file for complete search history.

(56) References Cited

U.S. PATENT DOCUMENTS 9,267,114 B2   2/2016   Yamshchikov

FOREIGN PATENT DOCUMENTS

| EP | 1 939 214 B1 | 7/2013 |
| EP | 1 599 495 B9 | 11/2013 |
| EP | 2 371 966 B1 | 11/2015 |
| WO | 2013/059493 A1 | 4/2013 |
| WO | 2013/083847 A2 | 6/2013 |
| WO | 2014/049094 A1 | 4/2014 |
| WO | 2016/130786 A2 | 8/2016 |
| WO | 2016/145149 A1 | 9/2016 |

OTHER PUBLICATIONS

Bradley and Nagamine, Comp Med, 2017, 67(3):242-252. (Year: 2017).*
Nürnburger et al., Journal of Virology, 2019, 93(3):e01485-18, 15 pages. (Year: 2019).*
Heinz and Stiasny, Vaccine, 2012, 30:4301-4306. (Year: 2012).*
Kuno and Chang, Arch. Virol., 2007, 152:687-696. (Year: 2007).*
Allison et al., "Mutational Evidence for an Internal Fusion Peptide in Flavivirus Envelope Protein E," *J. Virol.* 75(9):4268-4275, 2001.
Baronti et al., "Complete Coding Sequence of Zika Virus from a French Polynesia Outbreak in 2013," *Genome Announcements* 2(3):e00500-14, 2014. (2 pages).
Clements et al., "Development of a Recombinant Tetravalent Dengue Virus Vaccine: Immunogenicity and Efficacy Studies in Mice and Monkeys," *Vaccine* 28(15):2705-2715, 2010. (26 pages).

(Continued)

*Primary Examiner* — Stacy B Chen
(74) *Attorney, Agent, or Firm* — Seed Intellectual Property Law Group LLP

(57) ABSTRACT

The present invention relates to the provision of immunogenic or vaccine compositions comprising at least one recombinant Zika virus antigen, wherein the at least one recombinant Zika virus antigen is encoded by at least one nucleic acid sequence encoding at least one E-protein of a Zika virus or a functional fragment thereof. Further provided are nucleic acid molecules and a recombinant chimeric virus encoding and/or comprising selected antigens from a Zika virus, which are suitable as vaccine compositions. Preferably, the sequences encoding at least one Zika virus antigens suitable for eliciting an immune response are operably linked to a non-flavivirus derived vector backbone. Further provided are methods for purifying the recombinant chimeric virus particles or the immunogenic composition. Finally, there is provided an immunogenic/vaccine composition for use in a method of preventing or treating a Zika virus disease.

25 Claims, 1 Drawing Sheet
Specification includes a Sequence Listing.

(56) References Cited

OTHER PUBLICATIONS

Combredet et al., "A Molecularly Cloned Schwarz Strain of Measles Virus Vaccine Induces Strong Immune Responses in Macaques and Transgenic Mice," *J. Virol.* 77(21):11546-11554, 2003.
Davis et al., "West Nile Virus Recombinant DNA Vaccine Protects Mouse and Horse from Virus Challenge and Expresses In Vitro a Noninfectious Recombinant Antigen That Can Be Used in Enzyme-Linked Immunosorbent Assays," *J. Virol.* 75(9):4040-4047, 2001.
Després et al., "Live Measles Vaccine Expressing the Secreted Form of the West Nile Virus Envelope Glycoprotein Protects against West Nile Virus Encephalitis," *J. Infect. Dis.* 191(2):207-214, 2005.
Fritz et al., "The Unique Transmembrane Hairpin of Flavivirus Fusion Protein E Is Essential for Membrane Fusion," *J. Virol.* 85(9):4377-4385, 2011.
GenBank, "Zika virus strain BeH818995 polyprotein gene, complete cds," Accession No. KU365777.1, Jan. 26, 2016, 4 pages.
GenBank, "Spondweni virus strain SM-6 V-1 polyprotein gene, complete cds," Accession No. DQ859064.1, Dec. 24, 2009, 5 pages.
GenBank, "Spondweni virus, complete genome," Accession No. NC_029055.1, Aug. 13, 2018, 6 pages.
GenBank, "Zika virus genomic RNA, complete genome, strain: MR766-NIID," Accession No. LC002520.1, Sep. 12, 2014, 4 pages.
GenBank, "Zika virus isolate ARB13565 polyprotein gene, complete cds," Accession No. KF268948.1, Dec. 21, 2015, 4 pages.
GenBank, "Zika virus isolate ARB15076 polyprotein gene, complete cds," Accession No. KF268949.1, Dec. 21, 2015, 4 pages.
GenBank, "Zika virus isolate ARB7701 polyprotein gene, complete cds," Accession No. KF268950.1, Dec. 21, 2015, 4 pages.
GenBank, "Zika virus isolate Brazil-ZKV2015, complete genome," Accession No. KU497555.1, Feb. 18, 2016, 4 pages.
GenBank, "Zika virus isolate CPC-0740 polyprotein gene, complete cds," Accession No. KU681082.2, Feb. 18, 2016, 4 pages.
GenBank, "Zika virus isolate GD01 polyprotein gene, complete cds," Accession No. KU740184.1, Feb. 22, 2016, 4 pages.
GenBank, "Zika virus isolate SSABR1, complete genome," Accession No. KU707826.1, Jul. 14, 2016, 4 pages.
GenBank, "Zika virus isolate SV0127/14 polyprotein gene, complete cds," Accession No. KU681081.2, Feb. 18, 2016, 4 pages.
GenBank, "Zika virus isolate VE_Ganxian, complete genome," Accession No. KU744693.1, May 3, 2016, 5 pages.
GenBank, "Zika virus isolate Z1106033 polyprotein gene, complete cds," Accession No. KU312312.1, Jan. 13, 2016, 4 pages.
GenBank, "Zika virus isolate Zika virus/H.sapiens-tc/PHL/2012/CPC-0740, complete genome," Accession No. KU681082.3, May 24, 2016, 5 pages.
GenBank, "Zika virus isolate Zika virus/H.sapiens-tc/THA/2014/SV0127-14, complete genome," Accession No. KU681081.3, May 24, 2016, 5 pages.
GenBank, "Zika virus isolate ZIKV/Monkey/Uganda/MR766/1947, complete genome," Accession No. NC_012532.1, Aug. 13, 2018, 6 pages.
GenBank, "Zika virus polyprotein gene, complete cds," Accession No. EU545988.1, Jul. 30, 2008, 4 pages.
GenBank, "Zika virus strain 103344 polyprotein gene, complete cds," Accession No. KU501216.1, Feb. 1, 2016, 4 pages.
GenBank, "Zika virus strain 8375 polyprotein gene, complete cds," Accession No. KU501217.1, Feb. 1, 2016, 4 pages.
GenBank, "Zika virus strain ArB1362 polyprotein gene, complete cds," Accession No. KF383115.1, Mar. 15, 2014, 4 pages.
GenBank, "Zika virus strain ArD128000 polyprotein gene, complete cds," Accession No. KF383117.1, Mar. 15, 2014, 4 pages.
GenBank, "Zika virus strain ArD157995 polyprotein gene, complete cds," Accession No. KF383118.1, Mar. 15, 2014, 4 pages.
GenBank, "Zika virus strain ArD158084 polyprotein gene, complete cds," Accession No. KF383119.1, Mar. 15, 2014, 4 pages.
GenBank, "Zika virus strain ArD7117 polyprotein gene, complete cds," Accession No. KF383116.1, Mar. 15, 2014, 4 pages.
GenBank, "Zika virus strain BeH815744 polyprotein gene, complete cds," Accession No. KU365780.1, Jan. 26, 2016, 4 pages.
GenBank, "Zika virus strain BeH819015 polyprotein gene, complete cds," Accession No. KU365778.1, Jan. 26, 2016, 4 pages.
GenBank, "Zika virus strain BeH819966 polyprotein gene, complete cds," Accession No. KU365779.1, Jan. 26, 2016, 4 pages.
GenBank, "Zika virus strain H/PF/2013 polyprotein gene, complete cds," Accession No. KJ776791.1, Jun. 13, 2014, 4 pages.
GenBank, "Zika virus strain Haiti/1225/2014, complete genome," Accession No. KU509998.1, Feb. 2, 2016, 5 pages.
GenBank, "Zika virus strain MR 766 polyprotein gene, complete cds," Accession No. KU720415.1, Feb. 22, 2016, 4 pages.
GenBank, "Zika virus strain MR 766 polyprotein gene, complete cds," Accession No. DQ859059.1, Dec. 24, 2009, 5 pages.
GenBank, "Zika virus strain MR 766, complete genome," Accession No. AY632535.2, Nov. 23, 2010, 4 pages.
GenBank, "Zika virus strain MRS_OPY_Martinique_PaRi_2015 polyprotein gene, complete cds," Accession No. KU647676.1, Jun. 7, 2016, 4 pages.
GenBank, "Zika virus strain Natal RGN, complete genome," Accession No. KU527068.1, Oct. 6, 2016, 4 pages.
GenBank, "Zika virus strain PRVABC59, complete genome," Accession No. KU501215.1, Feb. 1, 2016, 4 pages.
GenBank, "Zika virus strain ZikaSPH2015, complete genome," Accession No. KU321639.1, Apr. 5, 2016, 5 pages.
Konishi et al., "Dengue type 2 virus subviral extracellular particles produced by a stably transfected mammalian cell line and their evaluation for a subunit vaccine," *Vaccine* 20(7-8):1058-1067, 2002.
Konishi et al., "Generation and Characterization of a Mammalian Cell Line Continuously Expressing Japanese Encephalitis Virus Subviral Particles," *J. Virol.* 75(5):2204-2212, 2001.
Koraka et al., "Bioinformatics in New Generation Flavivirus Vaccines," *Journal of Biomedicine and Biotechnology* 9(5):864029, 2010. (17 Pages).
Pierson et al., "Structural Insights into the Mechanisms of Antibody-Mediated Neutralization of Flavivirus Infection: Implications for Vaccine Development," *Cell Host Microbe* 4(3):229-238, 2008. (21 Pages).
Quinan et al., "An intact signal peptide on dengue virus E protein enhances immunogenicity for CD8+ T cells and antibody when expressed from modified vaccinia Ankara," *Vaccine* 32(25):2972-2979, 2014.
Stiasny et al., "The Membrane-Proximal "Stem" Region Increases the Stability of the Flavivirus E Protein Postfusion Trimer and Modulates Its Structure," *Journal of Virology* 79(17):9933-9938, 2013.
Veljkovic et al., "Possible repurposing of seasonal influenza vaccine for prevention of Zika virus infection [version 1; referees: 1 approved, 1 approved with reservations]," *F1000Res.* 5:190, 2016. (6 Pages).
Wang et al., "Efficient Assembly and Secretion of Recombinant Subviral Particles of the Four Dengue Serotypes Using Native prM and E Proteins," *PLoS One* 4(12):e8325, 2009. (13 Pages).
Zlatkovic et al., "Immunodominance and Functional Activities of Antibody Responses to Inactivated West Nile Virus and Recombinant Subunit Vaccines in Mice," *J. Virol.* 85(5):1994-2003, 2011.
Schrauf et al., "Current Efforts in the Development of Vaccines for the Prevention of Zika and Chikungunya Virus Infections," *Frontiers in Immunology* 11(592):1-20, 2020.
Brandler et al., "A recombinant measles vaccine expressing chikungunya virus-like particles is strongly immunogenic and protects mice from lethal challenge withh chikungunya virus," *Vaccine* 31:3718-3725, 2013.
Jungbauuer et al., "Monoliths for fast bioseparation and bioconversion and their applications in biotechnology," *J. Sep. Sci.* 27:767-778, 2004.
Nestola et al., "Improved Virus Purification Processes for Vaccines and Gene Therapy," *Biotechnology annd Bioengineering* 112(5):843-857, 2015.
Rajamanickam et al., "Monoliths in Bioprocess Technology," *Chromatography* 2:195-212, 2015.

(56) References Cited

OTHER PUBLICATIONS

Vicente et al., "Large-scale production and purification of VLP-based vaccines," *Journal of Invertebrate Pathology* 107:S42-S48, 2011.

* cited by examiner

Zika virus polyprotein

| C | prM | | E | | | NS1 | stem anchor region

▨ prM signal sequence
▦ E signal sequence
☰ Helices
■ TM Domain

Inserts:

Zika sE  ★▨ prM ▦ E ◇◇◇

L107D

Zika RSP  ★▨ prM ▦ E ☰■ ◇◇

★ Kozak sequence
◇ Stop codons

RECOMBINANT ZIKA VACCINES

STATEMENT REGARDING SEQUENCE LISTING

The Sequence Listing associated with this application is provided in text format in lieu of a paper copy, and is hereby incorporated by reference into the specification. The name of the text file containing the Sequence Listing is 900259_401USPC_SEQUENCE_LISTING.txt. The text file is 1.89 MB, was created on Nov. 20, 2018, and is being submitted electronically via EFS-Web.

TECHNICAL FIELD

The present invention relates to the provision of immunogenic or vaccine compositions comprising at least one recombinant Zika virus antigen, wherein the at least one recombinant Zika virus antigen is encoded by at least one nucleic acid sequence encoding at least one E-protein of a Zika virus or a functional fragment or variant thereof. Further provided are nucleic acid molecules and a recombinant chimeric virus encoding and/or comprising selected antigens from a Zika virus, or variants thereof, which are suitable as immunogenic or as vaccine compositions. Preferably, the sequences encoding at least one Zika virus antigens suitable for eliciting an immune response are operably linked to a non-flavivirus derived vector backbone to provide an efficient and safe vector backbone for vaccine production and vaccination. In certain embodiments, the nucleic acid molecule or the immunogenic composition do not encode/contain capsid or non-structural proteins derived from a Zika virus other than a Zika-virus E-protein/prM or functional fragments or variants thereof. Further provided are methods for purifying the recombinant chimeric virus particles or the immunogenic composition to provide an immunogenic composition with a low level of process- or product-related impurities. Finally, there is provided an immunogenic composition, preferably a vaccine composition for use in a method of preventing or treating a Zika virus disease in a subject.

BACKGROUND OF THE INVENTION

Emerging and re-emerging infectious diseases represent an ongoing threat for public health instead of all global vaccination efforts. Especially phenomena like the ongoing climate change, the increased mobility of human populations, environmental modification and the widespread and injudicious use of antimicrobials are factors contributing to the problem of eradicating viral, microbial and other pathogenic infections.

Zika virus is an emerging mosquito-borne virus that was first identified in Uganda in 1947 in rhesus monkeys through a monitoring network of sylvatic yellow fever. It was subsequently identified in humans in 1952 in Uganda and the United Republic of Tanzania. Outbreaks of Zika virus disease have been recorded in Africa, the Americas, Asia and the Pacific. Recently, Zika virus achieved unfortunate notoriety due to an outbreak in South America, Central America, and the Caribbean. In turn, the WHO declared that Zika virus constitutes a public health emergency of international concern, particularly due to the fact that Zika virus can presumably spread from a pregnant woman to her fetus. There have been reports of a serious birth defect of the brain called microcephaly in babies of mothers who had Zika virus while pregnant. Knowledge of the link between Zika and birth defects is evolving, but until more is known, health organisations like the CDC recommend special precautions for pregnant women. These serious events represented a wake-up call to face the fact that presently no preventive vaccine or specific curative treatment exists to combat a Zika virus infection. Even though the symptoms associated with a Zika virus infection are usually very mild, the risk for pregnant women represents an outstanding threat associated with this viral disease. Furthermore, a potential link to Zika infection is also suspected in adults diagnosed with Guillain-Barré syndrome, a rare autoimmune disorder that can cause paralysis. There exists thus a great need in providing safe vaccines eliciting a protective immune response to protect from Zika virus disease. Zika virus disease outbreaks were reported for the first time from the Pacific in 2007 and 2013 (Yap and French Polynesia, respectively), and in 2015 from the Americas (Brazil and Colombia) and Africa (Cape Verde). In addition, more than 13 countries in the Americas have reported sporadic Zika virus infections indicating rapid geographic expansion of Zika virus. According to a recent report from December 2016 by the WHO, Zika virus continues to spread geographically to areas where competent vectors are present. Although a decline in cases of Zika infection has been reported in some countries, or in some parts of countries, vigilance needs to remain high. Presently, 75 countries and territories have reported evidence of mosquito-borne Zika virus transmissions since 2007, 69 with reports from 2015 onwards. 12 countries have reported evidence of person-to-person transmission of Zika virus. 28 countries or territories have reported microcephaly and other CNS malformations potentially associated with Zika virus infection, or suggestive of congenital infection. These data demonstrate the ongoing geographical spread of Zika virus and underpin the need to develop safe vaccines providing protection against Zika virus infection.

Zika virus belongs to the genus Flavivirus within the family of Flaviviridae. Flaviviruses are small, enveloped, positive-strand RNA viruses that are generally transmitted by infected mosquitoes and ticks. Several flaviviruses, such as yellow fever, dengue, Japanese encephalitis, tick-borne encephalitis, Dengue virus, Saint Louis encephalitis virus, and West Nile viruses, pose current or potential threats to global public health. Yellow fever virus, for example, has been the cause of epidemics in certain jungle locations of sub-Saharan Africa, as well as in some parts of South America. Although many yellow fever virus infections are mild, the disease can also cause severe, life-threatening illness. The initial or acute phase of the disease state of certain Flavivirus diseases is normally characterized by high fever, chills, headache, backache, muscle ache, loss of appetite, nausea, and vomiting. The vector transmitting Zika virus to human beings is usually a mosquito from the genus *Aedes*. Members of the *Aedes* genus are known vectors for numerous viral infections. The two most prominent species that transmit viruses are *Aedes aegypti* and *Aedes albopictus* which transmit the viruses that cause dengue fever, yellow fever, West Nile fever, chikungunya, eastern equine encephalitis, or Zika virus disease.

Concerning Zika virus caused disease, the symptoms are usually fever, rash, joint pain, or conjunctivitis (red eyes). Other common symptoms include muscle pain and headache. The incubation period (the time from exposure to symptoms) for Zika virus disease is not known, but is likely to be a few days to a week. The illness is usually mild with symptoms lasting for several days to a week. Zika virus usually remains in the blood of an infected person for about a week but it can be found longer in some people. There exists first evidence that Zika can be sexually transmitted. Given the fact that Zika virus infections have been confirmed in several infants with microcephaly from Brazil and that the time frame and geographic location of reports of infants with microcephaly coincides with the outbreak of Zika virus infections in Brazil, there is a strong presumption that the virus is associated with this pathology.

Hamel, R. et al. (2015, J. Virol., 89, 8880-8896) showed that Zika virus, similar to dengue virus, appears to use the C-type lectin receptor DC-SIGN and members of the TIM and TAM families of phosphatidylserine receptors on host cell surface to gain access to the cytoplasm via receptor-mediated endocytosis. Thus, these findings support that dermal fibroblasts, keratinocytes as well as immature dendritic cells can be readily infected and can support viral replication.

Vaccination is one of the oldest yet still most effective methods to prevent infectious diseases. However, eradication of intracellular pathogens, including viruses, and treatment of certain diseases like cancer requiring efficient cytotoxic immune responses remain a challenge. Concerning safety issues of viral vaccines, especially life attenuated viruses (LAVs) have been used for a long time as efficient vaccines for humans and animals. As LAVs are derived from the disease-causing pathogen, but have been attenuated in a purposive manner under laboratory conditions, they are suitable to stimulate a good immune response. They will grow in a vaccinated individual, but because they are attenuated, they will cause no or very mild disease, however, still being infectious. Currently, there are several LAVs approved by the WHO including an oral polio vaccine, a measles vaccine, a rotavirus and a yellow fever vaccine. Still, several safety and stability issues remain in the context of LAVs, which still contain potentially infectious material, inter alia concerning issues like reversion, purity and potential contaminations in the viral preparation used as vaccine and the like.

Concerning LAVs, EP 1 939 214 B1 discloses that live attenuated RNA viruses especially the measles vaccine, has been used in hundreds of millions of children and has been proven to be effective and safe. This vaccine induces life-long immunity after one or two injections. It is easily produced on a large scale at low cost in most countries. These advantages make measles virus, especially attenuated vaccine strains, a good candidate vector to immunize children. Measles virus (MV) belongs to the genus *Morbillivirus* in the family Paramyxoviridae. It is an enveloped virus with a non-segmented RNA genome of negative polarity (15,894 bp). Measles can only be contracted once as the immune system mounts a strong specific response and establishes life-long memory protecting against re-infection. Such protection is based on both the production of antibodies and memory cytotoxic CD8+ T lymphocytes (CTL). Pathogenic strains strongly disrupt haematopoiesis (Arneborn et al., 1983; Kim et al., 2002; Okada et al., 2000) thus resulting in transitory immunosuppression responsible for most deaths due to measles infection in developing countries. In contrast to primary strains, attenuated strains do not induce immunosuppression (Okada et al., 2001). The Edmonston strain of measles virus was isolated in 1954 by culture in primary human cells (Enders et al., 1954). Adaptation to chicken embryonic fibroblasts produced vaccine seeds that were furthermore attenuated by subsequent passages in chicken embryonic fibroblasts (Schwarz et al., 1962). The Schwarz and Moraten strains that possess identical nucleotide sequences (Parks et al., 2001a; Parks et al., 2001 b) constitute the most frequently used measles vaccine. Vaccination with one or two injections induces life-long immunity (Griffin et al., 2001; Hilleman et al., 2002). The inventors of EP 1 939 214 B1 have developed a vector using the Schwarz MV, the most commonly used measles vaccine in the world (Combredet et al., 2003). This vector can stably express a variety of genes or combination of large genes for more than 12 passages. Recombinant MV vectors containing 4,000-5,000 additional nucleotides were produced, representing an additional 30% of genome. These viruses were produced in cell culture at titers comparable to standard MV. To optimize the output of the reverse genetics system, the antigenomic viral cDNA was placed under the control of the T7 phage RNA polymerase promoter with an additional GGG motif required for optimal efficacy. To allow exact cleavage of the viral RNA, a hammerhead ribozyme was inserted between the GGG motif and the first viral nucleotide, and the ribozyme from hepatitis delta virus was placed downstream of the last viral nucleotide. The resulting pTM-MVSchw plasmid enabled the production of the corresponding virus using a previously described reverse genetics system based on the transfection of human helper cells (Radecke et al., 1995). Furthermore, EP 1 939 214 B1 discloses that pTM-MVSchw plasmid was modified for the expression of foreign genes by the introduction of additional transcriptional units (ATU) at different positions of the genome. These ATUs are multi-cloning site cassettes inserted in a copy of the intergenic N-P region of the viral genome (containing the cis acting sequences required for transcription).

This basis recombinant and infectious measles vector thus allows the design of combined vaccines based on a live attenuated vaccine strain so that the recombinant measles virus vector is used as a scaffold for the introduction, production and purification of infectious virus particles expressing epitopes other than those derived from a measles virus strain.

EP 1 599 495 B9 discloses an example for a recombinant virus suitable as vaccine based on a defective or live attenuated measles virus. The patent discloses a recombinant virus comprising and thus being able to express antigens from a West Nile virus or a Dengue virus antigen. Notably, both West Nile virus and Dengue virus are flaviviruses. Therefore, these approaches demonstrate that a measles virus scaffold can be used to develop a vaccine against flaviviruses, of course given the time-consuming design and testing as associated with the production of any new vaccine, which has to fulfill two main requirements: (1.) it must be able to elicit an effective and thus protective immune response and (2.) it must be save, i.e. no side-effects jeopardizing the health of a subject to be treated.

Another suitable alternative for providing a backbone structure for expressing proteins of flaviviruses is disclosed in EP 2 371 966 B1, which discloses recombinant lentiviral vector for expression of a protein of a Flaviviridae and to its applications as a vaccine intended for the prevention and/or treatment of an infection with a virus of the family Flaviviridae, in a sensitive species (host or reservoir).

None of the above cited prior art, however, discloses or suggests a Zika virus immunogenic composition, or how a protective vaccine for Zika virus could be established fulfilling the needs of safety, protective immunity and broad availability as demanded by the presently prevailing fear that Zika virus, based in the enhanced globalization and also the increasing sphere of influence of regions, where *Aedes* mosquitoes can be detected, could rapidly expand its geographic expansion and thus potentially attack populations so far being immunologically devoid of any acquired defense against said viral disease.

Fully processed, mature virions of flaviviruses usually contain three structural proteins, capsid (C), membrane (M), and envelope (E), and seven non-structural proteins, NS1, NS2A, NS2B, NS3, NS4A, NS4B and NS5. The interior of the virion consists of an isometric nucleocapsid containing the unsegmented positive-stranded RNA genome complexed with the capsid protein C. The outer surface contains two membrane-anchored proteins: the envelope glycoprotein (E), which mediates fusion in the endosomal compartment after endocytosis, and the small membrane protein M (cf. Monath et al, 1996, Flaviviruses, p 961-1034). The genomic RNA of flaviviruses is combined with several copies of the capsid protein C so as to form the nucleocapsid. This capsid is surrounded by a viral envelope consisting of a double lipid layer derived from the endoplasmic reticulum (ER) membranes of the host cell, in which the envelope protein E and the membrane protein M are anchored. The Flavivirus genomic RNA usually contains a single open reading frame, flanked by two short non-coding regions at its 5' and 3' ends. The genome is translated into a polyprotein, which represents the precursor of the three structural proteins C, prM (intracellular precursor of M or pre-membrane protein) and E, in its N-terminal portion, and of at least five non-structural (NS) proteins NS1 to NS5, in its C-terminal portion. Immature flavivirions found in infected cells contain prM protein. The synthesis of the polyprotein is followed by a complex series of post-translational proteolytic cleavages of the polyprotein, to generate mature viral proteins (Amberg et al., J. Virol. 73: 8083-8094, 1999; Rice, "Flaviviridae," In Virology, Fields (ed.), Raven-Lippincott, New York, 1995, Volume I, p. 937). The virus structural proteins are arranged in the polyprotein in the order C-prM-E. The surface of the virus is composed of proteins M and E. So far, information on the flaviviral soluble E protein and prM from flaviviruses and their function are available for E proteins and/or prM from tick-borne encephalitis virus (TBEV) (see e.g. Fritz et al., "The Unique Transmembrane Hairpin of Flavivirus Fusion Protein E Is Essential for Membrane Fusion", J Virol. 2011 May; 85(9): 4377-4385) or for West Nile virus (WNV) (see e.g. Fritz et al., supra). For Japanese encephalitis virus (JEV) (see e.g. Konishi et al., "Generation and Characterization of a Mammalian Cell Line Continuously Expressing Japanese Encephalitis Virus Subviral Particles", J Virol. 2001 March; 75(5): 2204-2212) or for Dengue virus (see e.g. White et al., "An Alphavirus Vector-Based Tetravalent Dengue Vaccine Induces a Rapid and Protective Immune Response in Macaques That Differs Qualitatively from Immunity Induced by Live Virus Infection", J Virol. 2013 March; 87(6): 3409-3424, or Quinan et al., "An intact signal peptide on dengue virus E protein enhances immunogenicity for CD8(+) T cells and antibody when expressed from modified vaccinia Ankara", Vaccine. 2014 May 23; 32(25):2972-9) the possible immunological potential of viral proteins of these flaviviruses was analyzed. Heinz et al. (J of Virol., 1991, 5579-5583) discloses a membrane anchor-free and crystallisable form of the TBEV envelope glycoprotein E. Later on, this variant was also called soluble E (sE) for this and other flaviviruses. More specifically, the sE form this describes the E protein lacking the stem-anchor region (Stiasny et al., "The membrane-proximal "stem" region increases the stability of the flavivirus E protein postfusion trimer and modulates its structure", J. Virol., 2013, doi:10.1128/JVI.01283-13). Fritz et al. supra and Allison et al. (J Virol. 2001 May; 75(9):4268-75) additionally disclose so called recombinant subviral particles (RSPs) of TBEV as an experimental system, as those non-infectious capsid-less RSPs of TBEV have fusion characteristics similar to those of whole virions and modifications of the double membrane anchor are uncoupled from the second transmembrane (TM2) helix signal sequence function that would be required for virus replication, wherein the TBEV E protein is described as consisting of two antiparallel transmembrane helices (TM1 and TM2).

Allison et al. (J Virol. 2001, supra) identified that a highly conserved CD-loop of a TBEV E-protein and amino acid sequences comprised by said CD-loop, the CD-loop being located at the tip of each subunit might be important for fusion activity of the virus with target membranes. Furthermore, a mutational analysis is presented elucidating the role of conserved amino acid residues within the CD-loop.

U.S. Pat. No. 9,267,114 B2 discloses that the E protein of flaviviruses usually comprises a long ectodomain followed by a stem-anchor region. Three-dimensional structures of the flavivirus E protein ectodomain (about 400 amino acids, excluding the carboxy terminal stem and transmembrane domains) and its dimeric and trimeric forms have been solved and provided for E proteins of tick-borne encephalitis and dengue viruses, both in the prefusion and postfusion conformations. See Bressanelli et al., Structure of a flavivirus envelope glycoprotein in its low-pH-induced membrane fusion conformation, EMBO J. 12 1-12 (2004); Modis et al., A ligand-binding pocket in the dengue virus envelope glycoprotein, Proc Natl Acad Sci USA 100 6986-6991 (2003) Epub May 20, 2003; Modis et al., Structure of the dengue virus envelope protein after membrane fusion, Nature 427 313-319 (2004); Modis et al., Variable surface epitopes in the crystal structure of dengue virus type 3 envelope glycoprotein, J Virol 79 1223-1231 (2005); and Rey et al., The envelope glycoprotein from tick-borne encephalitis virus at 2 Å resolution, Nature 375 291-298 (1995), which are incorporated by reference. The ectodomain forms an elongated dimer that is oriented parallel to the viral membrane. In the head-to-tail dimer, each monomer is composed of domains I, II, and III. Monomer contacts in the dimer are not contiguous along the whole length of the molecule. There are two holes along the dimer axis that occupy the place of cleaved prM (see Rey et al., supra). Beyond two short α-helices in domain II, β-strands are predominant throughout the molecule. Each of the centrally located N-terminal domains I contains two disulfide bridges and carries a single carbohydrate side chain that shields the fusion peptide located on the tip of domain II and contributes to overall stability of the dimer (see Rey et al., supra). Domain II, or the dimerization domain, has an elongated finger-like structure and is involved in monomer-to-monomer interaction at two distinct loci. The distal loop is stabilized by three disulfide bridges and forms the tip that holds the fusion peptide, which fits into a hydrophobic pocket provided by domains I and III of the second monomer. This contact is largely nonpolar and is composed of residues from domains I and III on one subunit and the tip of domain II on the other. The contact at the center, where two prominent α-helices can be seen, mostly involves hydrophilic side chains of domain II only. Domain III contains the C terminus and in the virion is connected to the stem followed by the transmembrane region that anchors the monomer in the membrane. Furthermore, it is disclosed that despite the divergence in amino acid sequences of the E proteins of different flaviviruses, the 12 cysteine residues are absolutely conserved between species. These form six disulfide bridges in the West Nile virus E protein (see Nowak et al., Analysis of disulfides present in the membrane proteins of the West Nile flavivirus, Virology 156 127-137

(1987)) and were found at the expected positions in the X-ray structures of all E proteins determined to date.

U.S. Pat. No. 9,267,114 B2 is directed to a live attenuated flavivirus having at least one mutation in the central monomer contact interface sequence relative to a corresponding wild type sequence, as the region corresponding to amino acids 256 to 260 in relation to the West Nile virus envelope protein, which is said to decrease dissociation of the dimer as formed by a naturally occurring wild-type E-protein from a flavivirus. U.S. Pat. No. 9,267,114 B2, however, is completely silent as to the Zika virus sequences, the specific design of a Zika virus nucleic acid sequence or an immunological composition derived therefrom, which does not comprise such potentially attenuating mutations at amino acid positions 256 to 260, as a mutation in this region can also critically influences the RSP and viral particle formation, which might hamper efficient vaccination approaches and viral protein epitope presentation to immune cells, the latter presentation being key to an efficient vaccination approach providing long lasting cellular immunity.

Still, no attenuated Zika virus approved for vaccination and no systematic study exists, which would analyze the function of Zika virus proteins or pre-proteins and corresponding signal sequences/peptides for achieving neutralizing antibodies and/or a specific T-cell response by defining specific Zika virus derived epitopes which are both highly stable and simultaneously suitable to be presented to the immune system of a subject upon immunization so that a suitable immune response can be triggered, wherein the Zika virus proteins or pre-proteins are isolated from their natural genomic context and are presented in another vector backbone, preferably a vector backbone other than a flavivirus derived vector backbone, to provide a safe and efficient vaccine composition.

Stiasny et al. 2013 supra discloses that the E protein from tick-borne encephalitis virus (TBEV) forms trimers in a more stable way due to the N-terminal part of the stem, which also modulates the trimer structure outside the stem-interaction site. For this purpose, E trimers of TBEV with different C-terminal truncations were analyzed using two approaches: (i) assessment of the impact of the presence of the stem as well as parts thereof on the thermostability of E trimers, and (ii) examination of possible influences of stem interactions on the E trimer structure with conformation-specific monoclonal antibodies (MAbs). There is, however, no disclosure on Zika virus or any disclosure on the generation on suitable Zika virus vaccine compositions.

To finally bring a virus based vaccine preparation to the market, especially when the viral vector encodes at least one antigen of a viral pathogen not yet approved for therapy, it is not only required to provide recombinant infectious virus particles suitable to elicit a desired immune response, it is also mandatory to provide sufficient amounts, stable preparations and in a dosage form, which contains no residual contaminants of host cell DNA and proteins as remnants of the production of the infectious virus particles in a host cell and the subsequent isolation therefrom and optional treatment with enzymes like DNAses. The WHO and the responsible national and regional approval authorities, like the FDA in the USA and the EMEA in Europe, understandably impose high requirements to a composition used as vaccine comprising clinical trials and labeling to achieve the provision of safe biological products. The important hallmarks to be fulfilled by a vaccine candidate are its safety, purity and potency. Concerning product- or process-related impurities, in 1986, a WHO Study Group was convened in Geneva to discuss the safety concerns with the use of continuous cell lines for the production of biologicals. The conclusions from the discussions with respect to DNA was that for biologic products manufactured in continuous cell lines, the amount of DNA per parenteral dose should be 100 pg or less, a value that was considered to represent an insignificant risk. This was a conservative decision and was based predominantly on the results of studies on the oncogenic activity of polyoma virus DNA (see FDA: FDA Briefing Document Vaccines and Related Biological Products Advisory Committee Meeting Sep. 19, 2012). The value of 100 pg of host cell DNA per vaccine dose remained the recommended standard for a decade. However, the issue was revisited in 1997 for several reasons. First, vaccine manufacturers could not always meet this level of residual cell-substrate DNA for some viral vaccines, such as with certain enveloped viruses, e.g. the Measles virus. Second, more information was available as to the oncogenic events in human cancers, where it has been established that multiple events, both genetic and epigenetic, are required (for secondary literature, see FDA Briefing Document Vaccines and Related Biological Products Advisory Committee Meeting Sep. 19, 2012). Third, for continuous non-tumorigenic cell lines such as Vero, the major cell substrate that was being considered at the time, the presence of activated dominant oncogenes in these cells was unlikely. This last problem associated with Vero cells is nowadays studied in more detail and the recombinant cell lines available are well characterized and there are plenty of studies, e.g., concerning the number of passages suitable to use these specific cell lines under sustainably controlled conditions. The outcome of the 1997 WHO meeting was that the amount of residual cell-substrate DNA allowed per dose in a vaccine produced in a continuous cell line and one administered by the parenteral route was raised from 100 pg to 10 ng per dosis (Brown, F., E. Griffiths, F. Horaud, and J. C. Petricciani (ed.). 1998. Safety of Biological Products Prepared from Mammalian Cell Culture, vol. 93. Karger, Basel). As there are still concerns regarding DNA impurities in viral vaccines, there is an ongoing need in establishing purification schemes suitable for the industrial production of viral vaccines, especially for enveloped virus particles like the measles virus and measles virus scaffold based products to achieve a higher degree of purity and thus a better safety of the resulting product, so that product-related impurities, for example contaminating host cell DNA, but likewise process-related impurities, including contaminations by the inherently necessary cultivation in a suitable eukaryotic cell necessitating the addition of supplements, including serum or proteinases, are efficiently removed during production and optionally purification to achieve an acceptable medical product.

Therefore, there exists an urgent need to provide suitable immunogenic compositions or vaccines protecting a subject against Zika virus infection, preferably against infection with different Zika virus isolates, wherein the immunogenic compositions or vaccines elicit a protective immune response against Zika virus, have high safety and purity, and can be manufactured in a cost sensitive way to allow the provision of a safe vaccine. Particularly, it is an object to provide suitable Zika virus antigens or epitopes for use in an immunogenic or a vaccine composition, preferably in a recombinant chimeric form, so that a controllable attenuated chimeric recombinant virus can be provided, wherein the immunogenic or the vaccine composition can be produced as recombinant vaccine, whereas all production steps can be conducted under GMP conditions to define new vaccine candidates and vaccines for preventing Zika virus disease, where currently a prophylactic and/or therapeutic treatment is not at hand. Furthermore, due to the potential neurotropic and/or viscerotropic activity of certain Zika virus isolates, it was an object to present an immunogenic or a vaccine composition based on a nucleic acid molecule encoding a chimeric recombinant virus that only comprises selected antigens of the Zika virus and no full Zika virus backbone, particularly no non-structural proteins or the structural C-protein derived from Zika virus or another flavivirus, and optionally certain attenuating mutations, insertions and deletions to guarantee the safety of the resulting vaccine product.

SUMMARY OF THE INVENTION

The above-identified objects are solved by the technical teaching as provided with the present invention.

In a first aspect there is provided an immunogenic composition comprising at least one recombinant Zika virus antigen, wherein the at least one recombinant Zika virus antigen is encoded by at least one nucleic acid sequence encoding at least one E-protein of a Zika virus or a functional fragment thereof, wherein the at least one nucleic acid sequence encoding the at least one recombinant Zika virus antigen is operably linked to a vector backbone, preferably a non flavivirus derived vector backbone, the immunogenic composition optionally comprising at least one pharmaceutically and/or veterinarially acceptable carrier and/or excipient.

In one embodiment according to the first aspect, there is provided an immunogenic composition, (a) wherein the at least one nucleic acid sequence does not comprise a sequence encoding a stem-anchor region of an E-protein of a Zika virus, or a heterologous stem-anchor region for an E-protein of a Zika virus; or (b) wherein the at least one nucleic acid sequence encodes at least one E-protein of a Zika virus or a functional fragment thereof having a mutation at amino acid position 107 in comparison to the sequence of SEQ ID NOs:40 to 52 or 130 to 150 representing wild-type E-proteins of a Zika virus, and optionally wherein the at least one nucleic acid sequence comprises at least one sequence encoding a stem anchor region of an E-protein of a Zika virus, or a heterologous stem-anchor region for an E-protein of a Zika virus; and/or (c) wherein the at least one nucleic acid sequence encodes at least one E-protein of a Zika virus or a functional fragment thereof having a mutation L107D in comparison to the sequence of SEQ ID NOs:40 to 52 or 130 to 150, and/or (d) wherein the at least one nucleic acid sequence comprises a further sequence encoding a membrane protein of a Zika virus or a functional fragment thereof; and/or (e) preferably wherein the at least one nucleic acid sequence does not comprise a further nucleic acid sequence encoding a non-structural protein of a flavivirus.

In another embodiment according to the first aspect, the vector backbone is selected from the group consisting of a measles virus derived scaffold, a lentivirus derived scaffold or a modified vaccinia Ankara derived scaffold.

In yet a further embodiment according to the first aspect of the present invention, the vector backbone is derived from an attenuated virus measles virus strain, the measles virus strain preferably being selected from the group consisting of the Schwarz strain, the Zagreb strain, the AIK-C strain and the Moraten strain.

In still another embodiment according to the first aspect of the present invention, the immunogenic composition comprises at least one nucleic acid sequence or at least one amino acid sequence encoded by the at least one nucleic acid sequence, wherein the at least one nucleic acid sequence or the at least one amino acid sequence is selected from the group consisting of SEQ ID NOs: 27 to 39, 53 to 58, 61 to 66, 109 to 129, 151 and 152 or a sequence having at least 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% sequence homology thereto provided that the homologous sequence, optionally after expression, still encodes at least one functional Zika virus antigen.

In a second aspect according to the present invention there is provided a nucleic acid molecule, or an amino acid molecule encoded by the nucleic acid molecule, the nucleic acid molecule comprising at least one nucleic acid sequence, the at least one nucleic acid sequence comprising a first nucleic acid sequence encoding at least one E-protein of a Zika virus or a functional fragment thereof, and a second nucleic acid sequence encoding at least one E-protein signal sequence for a Zika virus E-protein or for a functional fragment thereof, and optionally comprising a third nucleic acid sequence encoding at least one pre-membrane protein of a Zika virus or a functional fragment thereof and optionally comprising a fourth nucleic acid sequence encoding at least one pre-membrane protein signal sequence for a Zika virus pre-membrane protein or for a functional fragment thereof, wherein the first and optionally the second and/or the third and/or the fourth nucleic acid sequence is/are independently derived from SEQ ID NOs: 1 to 13 and 67 to 87, preferably wherein the nucleic acid molecule does not comprise a nucleic acid sequence encoding a C-protein of a flavivirus, and/or preferably wherein the nucleic acid molecule does not comprise a further nucleic acid sequence encoding a non-structural protein of a flavivirus, (a) wherein the nucleic acid molecule additionally comprises a mutation within the first nucleic acid sequence at the position encoding amino acid position L107 of the E-protein of a Zika virus or the functional fragment thereof in comparison to the sequence of SEQ ID NOs:27 to 39, 40 to 52, 109 to 129 or 130 to 150, and optionally wherein the at least one first nucleic acid sequence comprises a sequence encoding the stem anchor region of the E-protein of a Zika virus independently derived from SEQ ID NOs: 1 to 13 and 67 to 87, or wherein the E-protein of a Zika virus comprises a heterologous stem-anchor region selected from any one of SEQ ID NOs: 185 to 191, or a sequence having at least 90%, 91%, 92%, 93%, 94%, 95%, 96%, 97%, 98% or 99% sequence homology thereto, or (b) wherein the nucleic acid molecule does not comprise a nucleic acid sequence encoding a stem anchor region of the E-protein of a Zika virus or a heterologous stem-anchor region for an E-protein of a Zika virus.

In one embodiment according to the second aspect of the present invention, the at least one first and optionally the second and/or the third and/or the fourth nucleic acid sequence is/are selected from the group consisting of SEQ ID NOs: 53 to 56 or 63 and 64 or a sequence having at least 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% sequence homology thereto provided that the homologous sequence after expression still encodes a functional Zika virus antigen.

In a third aspect according to the present invention, there is provided a recombinant chimeric virus comprising a vector backbone as defined in the embodiments of the first aspect of the present invention, and comprising at least one nucleic acid molecule according to the second aspect of the present invention, or comprising at least one nucleic acid sequence as defined in the embodiments of the first and second aspect of the present invention.

In one embodiment according to the third aspect of the present invention, the chimeric virus is encoded by a nucleic acid sequence selected from the group consisting of SEQ ID NOs: 57 or 58, or a sequence of SEQ ID NO: 60 or 192 comprising a further sequence encoding a sequence of SEQ ID NOs: 27 to 39, 40 to 52, 109 to 129 or 130 to 150 inserted between a BsiWI and a BssHII restriction site of SEQ ID NO:60 or of SEQ ID NO:192, or a sequence having at least 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% sequence homology thereto provided that the homologous sequence after expression still encodes chimeric recombinant virus particles.

In a further aspect, there is provided a host cell comprising at least one nucleic acid molecule, or comprising at least one nucleic acid sequence, or comprising at least one recombinant chimeric virus according to any one of the above aspects or embodiments.

In a further aspect according to the present invention there is provided a method for producing a recombinant chimeric virus according to the third aspect of the present invention, or for producing an immunogenic composition according to the first aspect of the present invention, the method comprising the following steps: (i) inserting at least one nucleic acid sequence as defined in for the first aspect of the present invention, or inserting at least one nucleic acid molecule according to the second aspect of the present invention into a vector backbone as defined for the first aspect of the present invention to operably link the nucleic acid sequence or molecule and the vector backbone to obtain a recombinant chimeric virus sequence; (ii) infecting at least one host cell with at least one recombinant chimeric virus sequence obtained in step (i) to obtain a virus sample; (iii) optionally: clarifying the virus sample of step (ii); (iv) optionally: purifying the clarified virus sample of step (iii); (v) optionally: formulating the at least one recombinant chimeric virus with at least one pharmaceutically and/or veterinarially acceptable carrier and/or excipient; (vi) obtaining a recombinant chimeric virus, or an immunogenic composition.

In one embodiment according to the above method, there is provided a method further comprising a purification step (iv), wherein the purification step comprises purification by means of chromatography, optionally, wherein purification is followed by an additional polishing step.

In a further embodiment according to the above method, the at least one host cell is selected from the group consisting of Vero cells, chicken embryo fibroblast cells, HEK293 cells, HeLa cells, fetal rhesus lung cells or MRC5 cells.

In yet a further embodiment according to the above method, the method comprises a further step, comprising (vii) separating recombinant subviral particles from infectious particles.

In a further aspect according to the present invention there is provided an immunogenic composition, preferably a vaccine composition, comprising an immunogenic composition according to the first aspect of the present invention, or comprising at least one nucleic acid molecule according to the second aspect of the present invention, or comprising at least one recombinant chimeric virus according to the third aspect of the present invention, for use in a method of preventing or treating a Zika virus disease in a subject.

In one embodiment, the immunogenic composition or the vaccine composition for use in a method of preventing or treating a Zika virus disease is characterized by a content of contaminating host cell DNA of less than 100 pg/dosis, preferably of less than 75 pg/dosis, more preferably of less than 50 pg/dosis, even more preferably of less than 25 pg/dosis and most preferably of less than 10 pg/dosis, wherein one dosis represents one dosis comprising the immunogenic or the vaccine composition to be administered to a subject in need thereof as a single dose.

Further aspects and embodiments of the present invention can be derived from the subsequent detailed description, the FIGURES, the Sequence Listing, as well as the attached set of claims.

BRIEF DESCRIPTION OF THE FIGURES

FIG. 1 (FIG. 1) is a schematic drawing showing, in the upper picture, the architecture of the N-terminal part of an exemplary Zika virus polyprotein. The term prM indicates a pre-membrane protein sequence. TM indicates a transmembrane segment. NS1 represents an abbreviation for the non-structural protein 1 of a Zika virus. The lower picture shows a schematic drawing of the Zika soluble E (sE) and the Zika recombinant subviral particle (RSP) construct, the RSP construct comprising an exemplary leucine to aspartic acid mutation at position 107. Kozak and stop sequences are shown for both, the sE and the RSP construct.

DEFINITIONS

A "viral particle" or "virus particle" or "recombinant infectious virus particle" as used herein refers to a single particle derived from a viral nucleic acid, which is located outside a cell. The viral particle thus represents the mature and infectious form of a virus. As the viral particle contains genetic information, it is able to replicate and/or it can be propagated in a susceptible host cell. Depending on the complexity of a virus, the viral particle comprises nucleic acid and polypeptide sequences and, optionally lipids, preferably in the form of a lipid membrane derived from the host cell.

A "virion" as used herein refers to a single particle derived from a viral nucleic acid, which is located outside a cell containing nucleic acids and thus being able to replicate or to be transcribed in a suitable host cell.

A "virus-like particle" or "VLP" as used herein refers to at least one virus particle, which does not contain any nucleic acid. VLPs or VLPs usually comprise at least one viral structural protein from a virus they are derived from and optionally lipid constituents. As such, they can be used to for vaccination or for inducing an immunogenic reaction in a subject, due to the absence of nucleic acids they will, however, not be able to replicate in a host cell and are thus non-replicative.

A "recombinant subviral particle" or "RSP" as used herein refers to at least one virus particle, particularly a flavivirus derived particle, which are non-infectious and comprise the envelope E- and pre-membrane (prM) proteins, yet no (nucleo)capsid. RSPs thus usually comprise the viral surface proteins from a virus they are derived from and optionally lipid constituents can thus be used to for vaccination or for inducing an immunogenic reaction in a subject, due to the absence of nucleic acids they will, however, not be able to replicate in a host cell. VLPs and RSPs according to the present invention are thus understood to represent particles lacking genetic information and are thus non-replicative. VLPs per se are thus non-infectious in the sense that they cannot replicate in a cell to give rise to new viral particles and thus to spread to further cells after a replicative cycle. Still, VLPs, after their assembly and based on the molecules exposed on their surface, can interact with a host cell and/or host cell molecules, e.g. surface receptors, or, after uptake and/or processing by an immune cell, e.g. an antigen-representing cell, epitopes or antigens comprised by a VLP can be presented or cross-presented by the immune cell to effector cells. By means of this interaction, VLPs can induce an immune response in an organism. This ability makes VLPs suitable structures for the provision of safe immunogenic or vaccine compositions.

A "virus sample", "virus material" or the like thus refers to a material comprising at least one of a (recombinant infectious) virus particle and/or a virion and/or a VLP and/or a RSP.

An "immunogenic composition" as used herein refers to a composition which is able to induce an immune response in a subject. An immunogenic composition according to the present disclosure usually comprises at least one vaccine composition comprising at least one Zika virus epitope and a suitable vector backbone platform. A vaccine or vaccine composition per se is thus also comprised by the term immunological composition. However, it is well known to the skilled person that for being suitable to administration to an animal, an immunogenic composition can additionally comprise suitable pharmaceutically and/or veterinary acceptable carriers.

The term "vaccine composition" as used herein refers to composition, preferably based on a virus particle and/or a VLP or RSP, which is able to induce a protective immune response in a subject.

As used herein, the term "immune response" refers to an adaptive immune response, e.g. the T cell response or to the increased serum levels of antibodies as resulting from exposure to an antigen due to a B-cell response, or presence of neutralizing antibodies to an antigen, or it refers to an innate immune response, e.g. mediated by the complement system and cells of the innate immune system like macrophages or dendritic cells. It also refers to an allergic response, inter alia including mast-cell, eosinophil or NK-cell action, T-cells, B-cell secreted antibodies. The term immune response is to be understood as including a humoral response and/or a cellular response and/or an inflammatory response.

The term "antigen" as used herein and as commonly used in the field of immunology refers to an "antibody generating" molecule, i.e. a substance, which can elicit an adaptive immune response. An antigen is thus a molecule binding to an antigen-specific receptor, either a T-cell or a B-cell receptor. An antigen is usually a (poly)peptide, but it can also be a polysaccharide or a lipid, possibly combined with a protein or polysaccharide carrier molecule. For the purpose of the various aspects and embodiments of the present invention, the antigen is a (poly)peptide, i.e. an amino acid sequence. In the case of binding to a T-cell receptor, the antigen is presented to the respective T-cell receptor via an antigen-presenting cell as an antigenic peptide bound to a histocompatibility molecule on the surface of the antigen presenting cell, wherein the antigenic peptide has been processed in advance by the antigen presenting cell. Antigen presentation by professional antigen-presenting cells (APC) is the first step towards the initiation of an adaptive immune response carried out by naïve T lymphocytes. Thus, an "antigen" as used herein refers to a molecule, such as a protein or a polypeptide, comprising one or more epitopes that will stimulate a host's immune system to make a humoral and/or cellular antigen-specific response. As such, an antigen can either be located on the surface exposed portion of a recombinant infectious virus or an RSP according to the present invention. An antigen can also be made accessible to the immune system of a subject after processing of a recombinant infectious virus or an RSP according to the present invention and can then be loaded onto a MHC molecule to be presented to a T cell to elicit an immune response.

An "epitope" as used herein can be a conformational epitope or a linear epitope. A conformational epitope is a sequence of sub-units, usually amino acids, composing an antigen that comes in direct contact with a receptor of the immune system. An antigen is any substance that the immune system can recognize as foreign. Antigens are usually proteins that are too large to bind as a whole to any receptor so only specific segments, that form the antigen, bind with a specific receptor, such segments usually being called "epitopes". Likewise, it is only paratope of the respective recognition receptor that comes in contact with the epitope. Whenever a receptor interacts with an undigested antigen, the surface amino acids that come in contact may not be continuous with each other if the protein is unwound. Such discontinuous amino acids that come together in three-dimensional conformation and interact with the receptor's paratope are called conformational epitopes. A linear epitope linear or a sequential epitope, in contrast, is an epitope that is recognized by the corresponding antigen receptor by its linear sequence of amino acids, or primary structure.

The term "protection" or "protective immunity" or "protective immune response" as used herein refers to the ability of a substance to induce the production of serum antibodies (adaptive humoral response) and/or a cellular response during immunization to protect (partially or totally) a subject having been treated with the substance against a virus of interest during a subsequent infection. Thus, an animal immunized by the compositions or vaccines of the invention will afterwards experience limited growth and spread if infected with the respective naturally occurring virus. Also an induced innate immune response mediated by immune cells of the innate immune system like macrophages or dendritic cells, can contribute to the protective effect of a substance, in case the substance stimulates said innate immune response, which can in turn contribute to enhance an adaptive immune response.

An "adjuvant" in the field of immunology and as used herein refers to a substance or composition enhancing antigenicity of another substance. This is achieved by specifically stimulating and balancing mainly the Th1 and Th2 subsets of T-cells and thus their effector molecules. Usually, immunogenic compositions based on live-attenuated or killed viruses are highly immunogenic per se and thus there might not be the need for an additional adjuvant, whereas an additional adjuvant might still be favourable to balance the provoked immune response. Th1 cells secrete IFN-γ, which activates macrophages and thus induces the production of opsonizing antibodies by B cells. The Th1 response therefore leads mainly to a cell-mediated immunity. Th2 cells mainly secrete cytokines, including IL-4, which induces B cells to make neutralizing antibodies. Th2 cells generally induce a humoral (antibody) response critical in the defense against extracellular pathogens (helminths, extracellular microbes and toxins).

The terms "genetically modified" or "recombinant" or "genetical engineering"/"genetically engineered" as used herein refer to any nucleic acid molecule and/or an amino acid molecule or a host cell implying a targeted and purposive manipulation and/or modification achieved by means of molecular biology or protein engineering, e.g. by introducing a heterologous sequence into another host cell, by modifying a naturally occurring nucleic acid sequences and the like. Further modifications include, but are not limited to, one or more point mutation(s), one or more point mutation(s), e.g. for targeted protein engineering or for codon optimization, deletion(s), and one or more insertion(s) of at least one nucleic acid or amino acid molecule, modification of an amino acid sequence, or a combination thereof. The terms can also imply a sequence, which per se occurs in nature, but has been purposively treated by means of molecular biology isolated from its natural environment in vitro.

A term "host cell" or "host cell population" as used herein refers to at least one but preferably more than one host cell(s). The term host cell comprises non-recombinant cells, i.e. cells that were not immortalized or transformed or manipulated in a purposive manner. The term host cell also comprises host cells. To be suitable for the purposes of the present invention, the host cell(s) of the cell population must be able to support the measles virus replication cycle, i.e. the cell(s) must be susceptible to measles virus or measles virus scaffold infection and the cell(s) must suitable for the subsequent propagation or replication cycle, including replication, translation encapsidation of the RNA of the virus and budding from the host cell to be released as virus particle. Several eukaryotic host cells are fulfilling this purpose are cited herein or known to the skilled person.

The terms "derived", "derivative", "derived from", "descendant" or "progenitor" as used herein in the context of either a host cell, a cell population or an infectious virus particle or in the context of nucleic acid sequences according to the present application relates to the descendants of such a host cell or infectious virus particle which results from natural reproductive propagation including sexual and asexual propagation and, in the context of virus nucleic acids, the propagation of the virus genetic material by the host cell machinery. It is well known to the person having skill in the art that said propagation can lead to the introduction of mutations into the genome of an organism resulting from natural phenomena which results in a descendant or progeny, which is genomically different to the parental host cell, however, still belongs to the same genus/species and possesses the same characteristics as the parental host cell. In the context of a nucleic acid sequence or any other biomolecule being “derived from” a certain sequence, e.g. a sequence as shown in the sequence listing according to the present application, or as derivable from a corresponding database, or a sequence derived from a scaffold structure, this term implies that the respective nucleic acid sequence is based on the reference sequence of the sequence listing, or a database accession number, or the respective scaffold structure, i.e. originating from said sequence, whereas the reference sequence can comprise more sequences, e.g. the whole genome or a full polyprotein encoding sequence, of a virus, whereas the sequence “derived from” the native sequence may only comprise one isolated gene or function fragment thereof, or a coherent fragment thereof. The skilled person can thus easily define a sequence “derived from” a reference sequence, which will, by sequence alignment on DNA or amino acid level, have a high identity to the respective reference sequence and which will have coherent stretches of DNA/amino acids in common with the respective reference sequence (>75% query identity provided that the derived sequence is the query and the reference sequence represents the subject during a sequence alignment). The skilled person can thus clone the respective sequences based on the disclosure provided herein by means of polymerase chain reactions and the like into a suitable vector system of interest, or use a sequence as vector scaffold. The term “derived from” is thus no arbitrary sequence, but a sequence corresponding to a reference sequence it is derived from, whereas certain differences, e.g. certain mutations naturally occurring during replication of a recombinant construct within a host cell, cannot be excluded and are thus comprised by the term “derived from”. Notably, in certain instances, e.g. related to an “antigen” according to the present invention, the term “derived from” specifies a nucleic acid sequence an antigen (the antigen being a amino acid sequence) originates from. The skilled person is well aware of the fact that this nucleic acid sequence according to the present invention will then be transcribed and translated in vivo and will be either presented to an immune cell, or it will be further digested and/or processed within a host cell so that the term “derived from” precisely indicates the sequence originally used according to the disclosure of the present invention. Therefore, it is more precise to define an antigen in a technical sense based on the corresponding nucleic acid sequence encoding said antigen. In the context of a virus, derivative or descendant or progenitor can thus naturally possess one or more mutations. Such derivatives or descendants resulting from natural phenomena during reproduction or propagation are thus comprised by the term host cell or cell population according to the present disclosure and the skilled person can easily define, by means of molecular biology, microscopy or the like, that the derivative or descendant is indeed derived from a parental host cell of the same genus. These terms, therefore, do not refer to any arbitrary derivative, descendant or progenitor, but rather to a derivative, or descendant or progenitor phylogenetically associated with, i.e. based on, a parent cell or virus or a molecule thereof, whereas this relationship between the derivative, descendant or progenitor and the “parent” is clearly inferable by a person skilled in the art.

The terms “fragment” or “functional fragment” as used herein in the context of amino acid/protein, or nucleic acid sequences, including sequences of viruses and vectors and scaffold based on said viruses, refers to a at least one coherent fragment, which is comprised by a whole, the reference sequence. The terms thus mean a portion or fragment of a whole capable of performing, in whole or in part, a function of the whole. For example, a biologically functional portion of a molecule means a portion of the molecule that performs a biological function of the whole or intact molecule, i.e. a nucleic acid sequence or an amino acid sequence, preferably an antigen sequence, according to the present invention. For example, a functional portion of a nucleic acid sequence or the encoded protein is a fragment or portion of the specified nucleic acid sequence or the encoded protein that comprises at least one coherent part of the native or wild-type sequence. Functional fragments are thus suitable for vaccination purposes to focus on a sub-fragment of a whole protein to specifically elect those parts of immunogenic interest. As such, a “functional fragment” per se has 100% sequence identity to the respective stretch of the sequence it is derived from over a given length of alignment. Still, a single nucleotide or amino acid may not be unambiguously attributable to a parent structure. In terms of absolute sequence identity, a “functional fragment” according to the present invention will thus not only be 100% identical to a given length over an alignment with the parent structure, but the “functional fragment” will have at least 15, at least 20, at least 25, at least 30, at least 35 or at least 40 nucleic acid positions in common with the respective parent structure (on DNA and/or amino acid level) it is derived from. In case that the parent sequence will comprise at least one mutation, the "functional fragment" can also comprise said mutation(s), or the "functional fragment" can comprise at least one additional mutation to optimize its properties (e.g., expression rate, folding characteristics, presentation to immune cells, immunogenicity in vitro and in vivo) desirable according to the present disclosure. The fragment will, however, be shorter than the sequence it is derived from. A functional fragment according to the present invention can thus, for example, be a soluble E-protein of a Zika virus, which lacks the stem-anchor region. A functional fragment can be a truncated, i.e. shorter version of a protein it is derived from, or from the corresponding nucleic acid sequence encoding the protein. The "functional fragment" can comprise additional point mutations for modulating the function thereof. Even though being structurally related to parent structure, the "functional fragment" can have altered immunogenic properties, depending on its recognition and processing by the immune system.

The terms "chimeric", or a "chimeric virus", or a "(recombinant) chimeric virus particle" as used herein refers to any virus particle, RSP or VLP, or a mixture thereof which originates from a nucleic acid molecule comprising sequences of different, i.e. at least two, organisms/viruses or from a recombinant molecule comprising sequences of different, i.e. at least two, organisms/viruses, whereas the resulting particles may only comprise sequences originating from one viral species, preferably sequences derived from a Zika virus, and the particles optionally comprising host cell derived material after processing and particle formation.

The terms "attenuation" or "attenuated" as used herein in connection with a virus strain or a material derived therefrom refers to a virus weakened under laboratory conditions which is less vigorous than the respective wild-type virus. An attenuated virus may be used to make a vaccine that is capable of stimulating an immune response and creating immunity, but not of causing illness.

The term "vector" or "plasmid vector" as used herein defines a system comprising at least one vector suitable for transformation, transfection or transduction of a host cell. A vector per se thus denotes a cargo for the delivery of a biomolecule into a host cell of interest, wherein the biomolecule includes a nucleic acid molecule, including DNA, RNA and cDNA or, in the case of a transfection system as vector, an amino acid molecule, or a combination thereof. A preferred vector according to the present invention is a plasmid or expression vector. An expression vector can comprise one vector encoding at least one target molecule, preferably a nucleic acid molecule, to be introduced into a host cell. A vector of the vector system can also comprise more than one target molecules to be introduced. Alternatively, the vector system can be built from several individual vectors carrying at least one target molecule to be introduced. An expression vector additionally comprises all elements necessary for driving transcription and/or translation of a sequence of interest in a host cell, the expression vector is designed for. These elements comprise, inter alia, regulatory elements, which are involved in the regulation of transcription, including promoters and the like functional in the host cell of interest. Furthermore, an expression vector comprises an origin of replication and optionally depending on the type of vector and the intended use a selectable marker gene, a multiple cloning site, a tag to be attached to a sequence of interest, a chromosomal integration cassette and the like. The choice and possible modification of a suitable expression vector for use with a respective host cell and sequence of interest to be inserted into the expression vector is well within the capabilities of the person skilled in the art.

The term "cDNA" stands for a complementary DNA and refers to a nucleic acid sequence/molecule obtained by reverse transcription from an RNA molecule. As it is a standard method for the person skilled in the art to obtain cDNAs from a given sequence and to further use this cDNA or to clone said cDNA into a vector, preferably a plasmid vector, of interest.

The term "regulatory sequence" as used herein refers to a nucleic acid sequence which can direct and/or influence the transcription and/or translation of a target nucleic acid sequence of interest. The term thus refers to promoter and terminator sequences or to polyadenylation signals and the like.

The terms "amino acid molecule/sequence", "protein", or "peptide" or "polypeptide" are used interchangeably herein without differentiating which length a specific amino acid sequence comprises. The term "amino acid" or "amino acid sequence" or "amino acid molecule" comprises any natural or chemically synthesized protein, peptide, or polypeptide or a modified protein, peptide, polypeptide and enzyme, wherein the term "modified" comprises any recombinant, chemical or enzymatic modification of the protein, peptide, polypeptide and enzyme or of the nucleic acid sequence encoding the same.

The terms "sequence(s)" and "molecule(s)" are used interchangeably herein when referring to nucleic acid or amino acid sequences/molecules.

As used herein, the term "pharmaceutically acceptable" refers to those compounds, materials, compositions, and/or dosage forms which are, within the scope of medical judgment or within the definition of any regulatory medical authority, suitable for contact with the cells, tissues, or components of a subject, i.e. human beings and animals, including contact with malignant cells or tissues of a subject, without excessive toxicity, irritation, allergic response, or other complications or side-effects commensurate with a reasonable benefit/risk ratio for a subject/patient.

"Subject", as used herein, may mean either a human or non-human animal. The term includes, but is not limited to, mammals (e.g., humans, other primates, pigs, rodents (e.g., mice and rats or hamsters), rabbits, guinea pigs, cows, horses, cats, dogs, sheep, and goats). In an embodiment, the subject is a human being.

"Treat", "treating" and "treatment", as used herein, mean the treatment of a disease in a mammal, e.g. in a human, including (a) inhibiting the disease, i.e. arresting its development; (b) relieving the disease, i.e. causing regression of the disease state; and (c) curing the disease. The terms "prevent" or "preventing" imply that a prophylactic treatment is provided before the onset of the disease or before the onset of the symptoms associated with a disease to be prevented.

Whenever the present disclosure relates to the percentage of the homology or identity of nucleic acid or amino acid sequences these values define those as obtained by using the EMBOSS Water Pairwise Sequence Alignments (nucleotide) programme (www.ebi.ac.uk) nucleic acids or the EMBOSS Water Pairwise Sequence Alignments (protein) programme (www.ebi.ac.uk) for amino acid sequences. Those tools provided by the European Molecular Biology Laboratory (EMBL) European Bioinformatics Institute (EBI) for local sequence alignments use a modified Smith-Waterman algorithm (see www.ebi.ac.uk and Smith, T. F. & Waterman, M. S. "Identification of common molecular subsequences" Journal of Molecular Biology, 1981 147 (1):195-197). When conducting an alignment, the default parameters defined by the EMBL-EBI are used. Those parameters are (i) for amino acid sequences: Matrix=BLOSUM62, gap open penalty=10 and gap extend penalty=0.5 or (ii) for nucleic acid sequences: Matrix=DNAfull, gap open penalty=10 and gap extend penalty=0.5.

The term "purifying" or "purify" as used herein in the context of purifying a biological material implies that the material of interest, i.e. recombinant infectious virus particles and/or VLPs and/or RSPs are separated from further constituents including any productor process related impurities as present due to the cultivation in a host cell or additives used during cell-culture or cell harvest/digest.

The term "polishing" as used herein in the context of a biological material implies that an already purified material is again subject to a further step of purification so that the resulting material of interest is made better than before in view of its purity. From a technical point of view, the means for purifying or polishing a material of interest can be the same to or different.

DETAILED DESCRIPTION

In a first aspect there is provided an immunogenic composition comprising at least one recombinant Zika virus antigen, wherein the at least one recombinant Zika virus antigen is encoded by at least one nucleic acid sequence encoding at least one E-protein of a Zika virus or a functional fragment thereof, wherein the at least one nucleic acid sequence encoding the at least one recombinant Zika virus antigen is operably linked to a vector backbone, preferably a non flavivirus derived vector backbone, the immunogenic composition optionally comprising at least one pharmaceutically and/or veterinarially acceptable carrier and/or excipient.

Notably, the immunogenic composition according to the present invention thus comprises at least one selected Zika virus antigen of E-protein of a Zika virus or a functional fragment thereof. The antigen thus refers to a amino acid based antigen.

In a preferred embodiment, no stem-anchor region for an E-protein or a functional fragment thereof is used within the nucleic acid sequences and molecules according to the present invention encoding the antigens and thus the immunogenic compositions according to the present invention. Lacking the membrane anchoring stem-anchor domain, said functional fragments of the E-protein are also referred to as soluble envelope proteins or "sE" proteins herein.

In one embodiment, the immunogenic composition can further comprise at least one nucleic acid sequence encoding a pre-membrane protein of a Zika virus (prM) or a fragment thereof. As detailed above the resulting prM protein as translated in a host cell or subject will then be further processed before its insertion as mature M protein into an envelope structure being composed of M- and E-proteins derived from a Zika virus, either in the form of a recombinant subviral particle (RSP) or in the form of an infectious virus particle associated with a suitable vector backbone, e.g. for a Zika construct comprising a soluble E-protein or a fragment thereof, the fragment not comprising a stem-anchor region (e.g. SEQ ID NO:57). The prM functions as chaperon assisting the proper folding of the full-length E-protein. In certain embodiments, core immunogenic constructs comprising an antigen derived from a soluble E protein or a fragment or variant thereof without a stem-anchor region is presented.

Therefore, in one embodiment, an immunogenic composition or a nucleic acid molecule according to the present invention will comprise a sequence encoding or encoded by a pre-membrane protein of a Zika virus (prM) or a functional fragment thereof, e.g. the residual portion of the prM protein as available after intracellular translation and processing, as well as a suitable signal sequence for the encoded prM protein (or nucleic acid molecules according to the present invention, also referred to as a fourth nucleic acid sequence herein. In the resulting immunogenic composition, the prM protein will be present in a form as processed by the at least one host cell used for propagation of the recombinant construct within the resulting recombinant virus or RSP in addition to a sequence corresponding to an E-protein or a functional fragment or a variant thereof, e.g. a truncated E-protein without a stem-anchor region and/or an E-protein comprising a mutation, for example at position 107 in comparison to a wild-type E-protein.

The processing within the host cell comprises cleavage of a prM signal sequence, e.g. sequence positions 105 to 125 of, e.g. SEQ ID NO:14 or the corresponding sequence corresponding to the prM signal sequence within SEQ ID NOs: 15-26 and 88-108.

In another embodiment according to the present invention, no additional sequence encoding or encoded by a pre-membrane protein of a Zika virus (prM) or a fragment thereof as well as a suitable signal sequence for the encoded prM protein, is contemplated.

In certain embodiments, the nucleic acid sequences according to the various aspects of the present invention can be codon-optimized. Codon optimization implies that the codon usage of a DNA or RNA is adapted to that of a cell or organism of interest to improve transcription rates, mRNA processing and/or stability, and/or translation rates, and/or subsequent protein folding of said recombinant nucleic acid in the cell or organism of interest. The skilled person is well aware of the fact that a target nucleic acid can be modified at one position due to the codon degeneracy, whereas this modification will still lead to the same amino acid sequence at that position after translation, which is achieved by codon optimization to take into consideration the species-specific codon usage of a target cell or organism. The preferred codon-optimization according to the present disclosure is codon-optimization for insect cell or mammalian cell, particularly human, codon usage, as the virus derived nucleic acid sequences according to the present invention will preferably be propagated in and/or used for insect and mammalian cells.

Even though being well characterized for flaviviruses other than Zika virus, the E-protein and other structural and non-structural proteins as encoded by a Zika virus coding DNA sequence (CDS) are much less characterized. The present disclosure is based on an extensive in silico comparison of available Zika virus and related viral CDS to define, clone and evaluate suitable Zika virus antigen encoding sequences. As no structural information on Zika virus is available, other than for other flaviviruses, including tick-borne encephalitis virus (TBEV) or for the West Nile virus (WNV), the inventors of the present invention established suitable nucleic acid sequences and constructs based on analogy to available sequence and tertiary structure information available for related viral species. It was found that the E-proteins from Zika virus as shown in SEQ ID NOs: 40 to 52 and 130 to 150 all have a relative high level of sequence conservation to each other.

As it was known for other E-proteins of TBEV (see e.g. Stiasny et al. or Allison et al., supra) that they are relevant for receptor recognition and membrane fusion necessary for viral entry into a cell and that they are necessary for RSP formation and harbor potentially relevant epitopes relevant for triggering an immune response (see e.g. Stiasny et al. or Allison et al., supra), a comparative analysis was performed for Zika and Spondweni virus CDSs. By in silico predictions it was found that the Zika virus polyproteins (SEQ ID NOs: 14 to 26 and 88 to 108) analyzed all are relatively highly conserved amongst various serotypes and comprise a sequence representing a prM protein (position 126 to 274 of SEQ ID NO:14 as reference sequence), a signal sequence preceding the prM protein (position 105 to 125 of SEQ ID NO:14 as reference sequence), a signal sequence preceding the E-protein (position 275 to 290 of SEQ ID NO:14 as reference sequence) and an E-protein (position 291 to 794 of SEQ ID NO:14 as reference sequence). In analogy to Stiasny et al., supra, positions 694 to 794 of SEQ ID NOs:14 to 26 and 88 to 108 and SEQ ID NOs: 185-191 were identified to represent putative stem-anchor regions of or for an E-protein of a Zika virus, i.e. the membrane-proximal helical region hypothesized to drive fusion and to increase stability of a full-length E-protein trimer. For dengue virus, this stem region as resolved for the structure of mature dengue 2 virions (Zhang et al., Nat. Struct. Mol. Biol., 2013, 20:105-110) was found to be composed of three helices. For Zika and Spondweni virus in silico prediction of the stem regions from SEQ ID NOs:14 to 26 and 88 to 108 suggests that there are two helices, helix 1 comprising residues 697 to 717 of the polyprotein according to any one of SEQ ID NOs:14 to 26 and 88 to 108 and SEQ ID NOs: 185-191 and helix 2 comprising residues 725 to 745 of the polyprotein according to any one of SEQ ID NOs:14 to 26 and 88 to 108.

Notably, the immunogenic compositions or nucleic acid molecules according to the present invention are not restricted to homologous stem-anchor sequences, for embodiments, where the use of a stem-anchor region is contemplated, but any suitable heterologous stem-anchor region can be used, preferably a stem-anchor sequence from another Zika virus, or a stem-anchor sequence from another virus, preferably a flavivirus other than Zika virus. Based on the disclosure provided herein, the skilled person by means of molecular cloning can easily substitute a homologous stem-anchor region of a Zika virus E-protein or fragment or variant thereof situated and the C-terminus of the naturally E-protein as detailed above by another stem-anchor sequence, e.g. a stem-anchor sequence from another Zika virus, or a stem-anchor sequence from a Dengue virus, a West Nile virus, a tick-borne encephalitis virus or another flavivirus. Suitable heterologous stem-anchor regions according to the present disclosure can be derived from a Tick-borne encephalitis virus (TBEV) stem-anchor sequence (SEQ ID NO:185), a Dengue virus stem-anchor sequence (SEQ ID NOs: 186, 187), a Japanese encephalitis stem-anchor sequence (SEQ ID NO:188), a St. Louis encephalitis virus stem-anchor sequence (SEQ ID NO: 189), a West Nile virus stem-anchor sequence (SEQ ID NO:190), or a Yellow fever virus encephalitis sequence (SEQ ID NO:191), or a sequence having at least 80%, 81%, 82%, 83%, 84%, 85%, 86%, 87%, 88%, 89%, 90%, 91%, 92%, 93%, 94%, 95%, 96%, 97%, 98% or 99% sequence identity to the any one of SEQ ID NOs:185-191 sequence.

At date, there are about 70 known flaviviruses, 30 of which have been associated with human diseases of varying incidence and severity. The flaviviruses were originally grouped and typed by their reactivity in serological assays (i.e., virus-neutralization, hemagglutination, and complement-fixation) according to their unique (virus specific) or shared (cross-reactive) antigenic determinants. These groupings were later confirmed and extended by monoclonal antibody mapping of discrete epitopic determinants and genetic sequence analysis of the viral RNAs. Arguably, the most medically important flaviviruses in terms of disease incidence and severity are the arthropod-borne viruses or Arboviruses, particularly those in Group B, which are transmitted by mosquito or tick vectors as detailed above. These include inter alia the dengue virus (DENV), yellow fever virus (YFV), Japanese encephalitis virus (JEV), and West Nile virus (WNV), Zika virus (ZIKV), St. Louis encephalitis virus (SLEV), Tick-borne encephalitis virus (TBEV) (including the Russian Spring Summer encephalitis virus (RS-SEV)). Due to taxonomical relationship of the above viruses, signal sequences for a Zika virus E-protein or functional fragment thereof, or for a prM protein, or a C-terminal heterologous stem-anchor region for a E-protein can also be derived from those viruses, e.g. from dengue virus (NCBI Reference Sequence: NC_001474.2), West Nile virus (NCBI Reference Sequence: NC_001563.2), Japanese encephalitis virus (NCBI Reference Sequence: NC_001437.1), Yellow fever virus (NCBI Reference Sequence: NC_002031.1), St. Louis encephalitis virus (NCBI Reference Sequence: NC_007580.2) or Tick-borne encephalitis virus (NCBI Reference Sequence: NC_001672.1) or from another flavivirus, another virus or, regarding signal sequences, from a host cell signal sequence, the latter signal sequences also being available to the skilled person as part of commercially available vectors. Suitable sequences can thus be defined based on the disclosure and the sequences provided herein by means of sequence alignments to identify sequences having a certain homology range, and/or by specific searches within signal peptide databases and the like.

To achieve optimal in vivo trafficking and/or processing off the E- and optionally the prM protein, both the sequence encoding the E-protein or a fragment thereof and the sequence encoding the prM protein or a fragment thereof can be preceded by a suitable signal sequence encoding a signal peptide enabling the translocation of the protein. Flaviviral gene expression starts from a polycistronic mRNA yielding a corresponding polyprotein, which traverses the membranes of the endoplasmic reticulum (ER) multiple times and is proteolytically cleaved into the different viral proteins. In certain embodiments, a Zika virus derived signal sequence can be used as detailed above for SEQ ID NOs: 14 to 26 and 88 to 108. In another embodiment, a signal sequence encoding a corresponding signal peptide can be positioned before the sequence encoding the E-protein or the prM-protein or a fragment thereof, whereas this heterologous sequence can be derived from another flavivirus or from any other species. For instance, it might be suitable to use an insect cell specific signaling sequence to achieve functional antigen assembly, when the nucleic acid sequences according to the present invention are produced in an insect cell. Likewise, human or humanized signal sequences can be used provided a corresponding authorization for vaccine production for the respective sequence. Any signal sequence can be placed in the region immediately upstream of the region encoding an antigenic protein of interest, preferably the signal sequence preceding the prM protein will be positioned at position 105 to 125 of SEQ ID NO:14 as reference sequence and a signal sequence preceding the E-protein will be positioned at position 275 to 290 of SEQ ID NO:14 as reference sequence. The person having skill in the art can thus easily defined suitable signal sequences encoding suitable signal peptides, which can be used according to the present disclosure at the correct position, either in front of the coding region for a E-protein or a functional fragment thereof, and/or in front of the coding region for a prM-protein or a functional fragment thereof of a Zika virus within a nucleic acid molecule of interest.

The term Zika virus antigen as used herein refers to an antigen, as defined above, wherein the nucleic acid sequence encoding the antigen is derived from the CDS of a Zika virus or a virus related to a Zika virus. Such a virus related to a Zika virus is Spondweni virus. Spondweni virus is an arbovirus, or arthropod-borne virus, which is also a member of the family Flaviviridae and the genus Flavivirus. Like Zika virus it is transmitted by mosquitoes. Comparing the sequence of the CDS of a Spondweni virus, see e.g. SEQ ID NO: 107 or 108, it was found that the E-protein as encoded by SEQ ID NO:107 has 74.0% identity and 86.4% similarity (Emboss Needle alignment above) to the sequence according to SEQ ID NO:40 (E-protein and stem-anchor region of Zika virus strain BeH818995) including certain highly conserved structural motifs as known for other Zika viruses (see Allison et al. supra). A fragment of an E- and also a prM-protein according to the present invention is thus at least one contiguous nucleic acid or amino acid sequence of the E- and/or the prM-protein, the E-protein spanning from position 291 to 794 of any one of SEQ ID NOs:14 to 26 and 88 to 108 and the prM-protein spanning from position 126 to 274 of any one of SEQ ID NOs:14 to 26 and 88 to 108 or being represented by any one of SEQ ID NOs:185-191.

As detailed above, flaviviruses and likewise Zika virus encode seven non-structural proteins, NS1, NS2A, NS2B, NS3, NS4A, NS4B and NS5. According to the present invention, the immunogenic composition does not comprise any Zika virus non-structural protein as antigen, as the amino acid sequences as comprised by said non-structural proteins usually contribute to the virion morphogenesis of the virus as they form the replicase complex or cofactors thereof (see Murray et al., Nat. Rev. Microbiol., 2008, 6(9):699-708). For the purpose of the present invention, however, said functions are not needed, as an immunogenic composition according to the present invention should be free of Zika virus or flavivirus derived proteins or genes involved in viral replication, as often used for chimeric flaviviruses (see EP 1 401 859 B1). In certain embodiments it might, however, be envisaged to use a Zika virus derived capsid (C) protein encoding nucleic acid sequence in combination with a Zika virus derived NS2B and/or NS3 encoding nucleic acid sequence. According to this embodiment, both, the C encoding sequence or a functional fragment thereof and the NS2B and/or NS3 encoding sequence or a catalytically active fragment thereof are provided, yet the function of the NS2B and/or NS3 sequence will lead to a cleavage of the C-protein so that the resulting Zika virus derived antigens will not comprise a C-protein derived antigen sequence.

Preferably, the vector backbone is a vector backbone other than a flavivirus vector backbone as carrier molecule, i.e. the immunogenic composition can be obtained from a chimeric nucleic acid molecule, whereas the vector backbone is not associated with, i.e. does not comprise, naturally occurring flaviviral or Zika viral sequences. This approach using a cross-genus or preferably even cross-species combination of a viral backbone and an antigen delivering insert is suitable and versatile to obtain an immunogenic composition both having a well defined and characterized viral epitope insert and a carrier molecule, preferably a vector backbone molecule which is safe in its use concerning medical applications. The vector backbone according to the present invention is operably linked to, i.e. covalently linked with at least one nucleic acid sequence of interest. The skilled person is aware of suitable methods of cloning a nucleic acid sequence of interest into a vector backbone of interest, whereas cloning can be performed enzymatically, for instance by way of ligation, or by enzyme-free cloning methods known in the field of molecular biology. Resulting infectious viral particles according to the present invention, at least in certain embodiments, can thus comprise both: sequences/molecules from a Zika virus as well as sequences/molecules originating from a vector backbone and optionally molecules originating from a host cell used for production of the infectious virus particles, the particles optionally comprising RSPs.

In one embodiment according to the first aspect, there is provided an immunogenic composition, (a) wherein the at least one nucleic acid sequence does not comprise a sequence encoding a stem-anchor region of an E-protein of a Zika virus, or a heterologous stem-anchor region for an E-protein of a Zika virus; or (b) wherein the at least one nucleic acid sequence encodes at least one E-protein of a Zika virus or a functional fragment thereof having a mutation at amino acid position 107 in comparison to the sequence of SEQ ID NOs:40 to 52 or 130 to 150 representing wild-type E-proteins of a Zika virus, and optionally wherein the at least one nucleic acid sequence comprises at least one sequence encoding a stem anchor region of an E-protein of a Zika virus, or a heterologous stem-anchor region for an E-protein of a Zika virus; and/or (c) wherein the at least one nucleic acid sequence encodes at least one E-protein of a Zika virus or a functional fragment thereof having a mutation L107D in comparison to the sequence of SEQ ID NOs:40 to 52 or 130 to 150, and/or (d) wherein the at least one nucleic acid sequence comprises a further sequence encoding a membrane protein of a Zika virus or a functional fragment thereof; and/or (e) preferably wherein the at least one nucleic acid sequence does not comprise a further nucleic acid sequence encoding a non-structural protein of a flavivirus.

For the L107D mutation it was found, in the context of RSP constructs, e.g. comprised by SEQ ID NO:58, that this mutation abolishes the fusion of the RSP with the cellular membrane of a target cell the mutation simultaneously showing no effect on subviral particle formation.

For various embodiments according to the present invention it was found that a mutation at position 107 encodes a protein comprising a Zika virus antigen, wherein the antigen can still be presented to a host cell and wherein the protein maintains its capacity to be expressed and secreted, yet the mutation at position 107, as observed for the E-protein of TBEV, had an attenuating function in comparison to the wildtype E-protein, which is favorable for any vaccination approach. Further mutations were carried out at position 107 of a Zika virus derived E-protein. The position was systematically mutated from leucine to a positive (arginine (R), histidine (H), lysine (K)) or negative (aspartic acid (D), glutamic acid (E)) charged amino acid. Additionally, leucine at position 107 was exchanged to proline (P) or to an aromatic side chain, including phenylalanine (F), tyrosine (Y) and tryptohane (W) or to a polar uncharged amino acid, namely serine (S), threonine (T), asparagines (N) and glutamine (Q). All but the proline mutation, presumably perturbing the conformation of the CD-loop as described for the TBEV protein above (see Allison et al.) and thus the E-protein ternary complex in association with other proteins or lipids, turned out to be suitable and were therefore included for vaccine design, with the L107D, the L107E, the L107N and the L107Q variant and the aromatic mutants, i.e. L107F, L107Y and L107W, representing one preferred candidates.

In a preferred aspect, the Zika virus E-protein antigen or the functional fragment thereof does not encode a stem-anchor region, i.e. no homologous or heterologous stem-anchor region is encoded by the relevant nucleic acid sequences. This allows the production of a soluble E-protein (sE) ectodomain restricted to surface exposed epitopes, which are of outstanding interest for generating a protective immune response against a Zika virus, the surface exposed E-protein residues being the most important source of epitopes to raise an immune response against flaviviruses. In addition, said core sE antigen turned out to provide a sound immune response as detailed below without introducing more than necessary into a protective Zika vaccine. Furthermore, these variants according to this embodiment do not comprise further sequences encoding non-structural proteins of a Zika virus or another flavivirus for the reasons detailed above. Corresponding sequences are shown inter alia in SEQ ID NOs: 53, 55 and 57 and can be derived from any one of SEQ ID NOs: 1-13, 67-87, 14-26, 88-108, 27-39, 109-129, 40-52 or 130-150.

According to the present invention, immunogenic compositions comprising one of the above L107 mutations in the E-protein or the sequence encoding the same can thus additionally comprise a stem-anchor sequence in one embodiment, or can lack an additional stem-anchor sequence in another embodiment.

In a further embodiment according to the various aspects of the present invention, the attenuating mutation L107D is incorporated into the nucleic acid sequence encoding a Zika virus derived E-protein or a fragment thereof, which is of special importance for an E-protein comprising a stem anchor region. Corresponding sequences are shown inter alia in SEQ ID NOs: 54, 56 and 58 and can be derived from any one of SEQ ID NOs: 1-13, 67-87, 14-26, 88-108, 27-39, 109-129, 40-52 or 130-150.

According to certain preferred embodiments, as also detailed above, the at least one nucleic acid sequence encoding at least one recombinant Zika virus antigen of an E-protein of a Zika virus or a functional fragment thereof will further comprises a further sequence encoding a membrane protein of a Zika virus or a functional fragment thereof.

Preferably, the nucleic acid molecules, the nucleic acid sequences and the immunogenic compositions according to the present invention will not comprise a further nucleic acid sequence encoding a non-structural protein of a flavivirus other than an E-protein or a fragment thereof of a Zika virus and optionally a (pr)M protein or a functional fragment thereof of a Zika virus. In certain embodiments, sequences encoding a capsid (C) protein or a functional fragment thereof of a Zika virus can be included into the nucleic acid molecules, the nucleic acid sequences and the immunogenic compositions according to the present invention.

In another embodiment according to the first aspect, the vector backbone is selected from the group consisting of a measles virus derived scaffold, a lentivirus derived scaffold or a modified vaccinia Ankara derived scaffold and thus a non-flavivirus derived vector backbone for the reasons detailed above.

Preferably, the vector backbone is an attenuated vector backbone, for example an extensively recombinantly modified vector backbone which results in an attenuated virus form, wherein the resulting virus form does no longer cause clinical symptoms as does the corresponding wild-type virus so that the vector backbone per se can be regarded as safe for vaccination approaches.

In yet a further embodiment according to the first aspect of the present invention, the vector backbone is derived from an attenuated virus measles virus strain, the measles virus strain preferably being selected from the group consisting of the Schwarz strain, the Zagreb strain, the AIK-C strain and the Moraten strain.

According to all aspects and embodiments of the present disclosure, an attenuated virus measles virus strain refers to a nucleic acid molecule comprising all, parts of the antig-enomic region of a measles virus, preferably including further recombinant enhancements. A suitable measles virus vector backbone is disclosed in SEQ ID NOs:59 and 60 as well as 192.

According to one embodiment of the various aspects of the present disclosure, the nucleic acid sequence encoding at least one Zika virus antigen can thus be a recombinant infectious virus particle comprising an infectious measles virus (MV) scaffold or backbone, preferably based on the Schwarz strain of the measles virus, which is known for a long time and approved as recombinant vaccine. For being suitable for the purpose of the present invention the MV vector backbone comprises the following gene transcription units encompassing from 5' to 3': (a) a polynucleotide encoding the N protein of a MV, (b) a polynucleotide encoding the P protein of a MV, (c) the polynucleotide encoding at least one structural protein used as Zika antigen, (d) a polynucleotide encoding the M protein of a MV, (e) a polynucleotide encoding the F protein of a MV, (f) a polynucleotide encoding the H protein of a MV, and (g) a polynucleotide encoding the L protein of a MV, said polynucleotides and nucleic acid construct being operably linked and under the control of viral replication and transcription regulatory sequences such as MV leader and trailer sequences. The expressions "N protein", "P protein", "M protein", "F protein", "H protein" and "L protein" refer respectively to the nucleoprotein (N), the phosphoprotein (P), the matrix protein (M), the fusion protein (F), the hemagglutinin protein (H) and the RNA polymerase large protein (L) of a Measles virus. These components have been identified in the prior art and are especially disclosed in Fields, Virology (Knipe & Howley, 2001). Hemagglutinin (H) and fusion protein (F) are components of the viral envelope which are responsible to mediate fusion with the host cells. H binds to CD46 and CD150 on the surface of a host cell. Especially H is very immunogenic in the host cell or organism and during a natural infection it is responsible for (life) long immunity that follows said infection. Said immunity is due to the establishing of cell-mediated memory and the production of neutralizing antibodies against H protein. During the replication cycle, synthesis of measles virus or measles virus scaffold mRNA, translation, and replication all take place in the cytoplasm of a host cell. The expression "operably linked" thus refers to the functional link existing between the at least one antigen encoding nucleic acid sequence according to the methods of the invention such that said at least one nucleic acid sequence within the measles virus scaffold is efficiently transcribed and translated, in particular in cells or cell lines, especially in cells or cell lines used as cell bank according to the present invention so that an antigenic epitope can be presented after. It is well within the capability of the person having skill in the art to clone a nucleic acid of interest into a measles virus scaffold as disclosed herein. The chimeric virus particles as obtainable according to the present invention thus synergistically provide a specific immune response against at least one epitope derived from a Zika virus E-protein together with the further properties detailed above associated with a MV vector backbone.

A particular cDNA nucleic acid molecule suitable for use in the embodiments according to all aspects of the present invention is the one obtained using the Schwarz strain of measles virus. Accordingly, the cDNA used within the present invention may be obtained as disclosed in WO 2004/000876 A1. The sequence of this plasmid without ATUs is disclosed herein as SEQ ID NO:59. A corresponding plasmid pTM-MVSchw has been obtained from a Bluescript plasmid and comprises the polynucleotide coding for the full-length measles virus (+) RNA strand of the Schwarz strain placed under the control of the promoter of the T7 RNA polymerase. SEQ ID NOs:60 and 192 then discloses the measles virus scaffold including an ATU2, both sequences only differing in the length of the remaining pBluescript backbone otherwise being identical. Further comprised is a NotI restriction enzyme-site (from the cloning vector, pBluescript), a T7 Promoter & T7 Terminator sequence, a 5': Hammerhead Ribozyme; 3': Hepatitis delta Ribozyme Sequence, a measles virus derived sequence, a measles promoter/terminator, and BsiWI and BssHII restriction sites unique for cloning of the nucleic acid molecules according to the present invention. SEQ ID NO:153 discloses a further measles virus scaffold based on the Schwarz strain and including an insert cloned within an ATU3 site. According to the present invention a cDNA nucleic acid molecule suitable for use according to the present invention comprises at least one antigen, which is derived from a Zika virus. The sequence according to SEQ ID NOs:59 or 60 or 192, which depicts an infectious MV cDNA corresponding to the anti-genome of the Schwarz MV vaccine strain, has been described elsewhere (Combredet, C, et al., A molecularly cloned Schwarz strain of measles virus vaccine induces strong immune responses in macaques and transgenic mice. J Virol, 2003. 77(21): 1546-54). For example, the cDNA encoding for the structural antigens of the Zika virus can be generated by chemical synthesis (GenScript, USA) or by recombinant cloning techniques available to the skilled person based on the present disclosure. The complete sequence, i.e. vector backbone plus Zika virus antigen encoding insert, has to respect the "rule of six", which stipulates that the number of nucleotides into the MV genome must be a multiple of 6, and contains BsiWI restriction site at the 5' end (position 3539-3544 of SEQ ID NO:60, 3526-3531 of SEQ ID NO:192), and BssHII at the 3' (position 3545 to 3550 of SEQ ID NO:60; position 3532 to 3537 of SEQ ID NO:192) end as evident from positions 3539 to 3550 of SEQ ID NO:60 or positions 3526 to 3537 of SEQ ID NO:192. The sequence was codon optimized for measles virus expression in mammalian cells. This cDNA was inserted into BsiWI and BssHII-digested pTM-MVSchw-ATU2, which contains an additional transcription unit (ATU) between the phosphoprotein (P) and the matrix (M) genes of the Schwarz MV genome (Combredet, C, et al., A molecularly cloned Schwarz strain of measles virus vaccine induces strong immune responses in macaques and transgenic mice. J Virol, 2003. 77(21): 1546-54). Representative nucleic acid sequences are represented in SEQ ID NO:57 (MV Zika sE) and SEQ ID NO:58 (MV Zika RSP). Rescue of a recombinant infectious virus particles derived from a measles virus scaffold can then be performed as previously described using a rescue system previously described (Radecke, F., et al., Rescue of measles viruses from cloned DNA. EMBO J, 1995. 14(23): p. 5773-84; WO 2008/078198 A2). Viral titers can be determined by endpoint limit dilution assay, e.g. on Vero cells, and $TCID_{50}$ can be calculated by using the Kärber method known to the person skilled in the art.

The person having skill in the art provided with the information of the present disclosure can easily determine the unique restriction sites present in SEQ ID NO:60 or 192 for the purpose of cloning, i.e. creating an operable linkage, between the recombinant infectious measles virus as vector backbone and a nucleic acid sequence encoding an antigen of a Zika virus operably linked to said measles virus vector backbone or scaffold. The skilled person can define a suitable cloning strategy to introduce a nucleic acid sequence of interest into a measles virus scaffold at different positions to allow a functional insertion. A functional insertion or the term operably linked in this context is thus intended to mean an introduction, which will allow the transcription and translation of all amino acid sequences encoded by the measles virus scaffold, i.e. the insertion may not disrupt a regulatory sequence, including a promoter and the like, or a amino acid coding sequence, including the structurally and functionally relevant proteins of the measles virus, i.e. the "N protein", "P protein", "M protein", "F protein", "H protein" and "L protein", or the antigen sequence introduced into the measles virus scaffold or backbone.

The present invention is not limited to the use of a flaviviral vector backbone. As further detailed below (see Example 15) other suitable vector backbones, e.g. a lentiviral vector backbone, preferably vector backbones approved for vaccination purposes, can be used as carrier molecules for the Zika virus antigens as disclosed herein to obtain an immunogenic composition.

The measles virus vector backbone or any other non-flavivirus derived backbone according to the present disclosure, from a structural point of view, will always represent the majority of the material to be transcribed/translated into a recombinant infectious virus particle. It will thus also predominantly influence the functional and biological characteristics of the envelope of the purified infectious virus particles and, in embodiments allowing the preparation of virus-like particles (VLPs) or recombinant subviral particles (RSPs) in the turn of replication of the measles virus scaffold comprising at least one nucleic acid sequence encoding at least one polypeptide, wherein the polypeptide is at least one Zika virus derived antigen, the methods disclosed herein allow the co-purification of measles virus scaffold derived virions and the VLPs/RSPs.

In still another embodiment according to the first aspect of the present invention, the immunogenic composition comprises at least one nucleic acid sequence or at least one amino acid sequence encoded by the at least one nucleic acid sequence, wherein the at least one nucleic acid sequence or the at least one amino acid sequence is selected from the group consisting of SEQ ID NOs: 27 to 39, 53 to 58, 61 to 66, 109 to 139, 151 and 152 or a sequence having at least 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% sequence homology thereto provided that the homologous sequence, optionally after expression, still encodes at least one functional Zika virus antigen.

The term "functional Zika virus" antigen in this context means a contiguous amino acid sequence as translated from the corresponding nucleic acid sequence, which comprises at least one antigen derived from the E-protein and optionally also the prM protein, which can undergo further post-translational processing and modification during the production in a host cell or subject, and will then properly fold in the form of a virus particle and/or a recombinant subviral particle so that the sequences of the E-protein and optionally also the prM protein are presented on the surface of the respective particle and are thus available for interaction with molecules from a host cell to be infected/vaccinated.

The Zika virus E-proteins form part of the viral surface and neutralizing antibodies were found to be predominantly raised against the E-protein part of the Zika virus polyprotein, namely the ectodomain or soluble E (sE) fraction thereof corresponding to amino acid sequences 291 to 693 of SEQ ID NOs: 14 to 26 and 88 to 108. Furthermore, a protective immune response could be achieved by using at least one contiguous fragment of the sE-protein derived from SEQ ID NO:14, i.e. SEQ ID NO:63 and 64 in an experimental setup (see below). The prM protein of the Zika virus according to SEQ ID NOs:1 and 14 was found to have useful chaperone activity concerning the E-protein or fragment thereof, whereas the antigenic impact was mainly achieved by the E-protein portion. Therefore, in certain embodiments, the inclusion of a nucleic acid sequence encoding a Zika virus derived prM protein, and optionally also including a suitable signal peptide encoding sequence, might be favorable, yet not necessary to elicit a protective immune response against Zika virus. Inclusion of a prM protein encoding sequence and a E-protein encoding sequence, or respective fragments, from different Zika virus serotypes can be favourable to achieve a broad scope of protection against several Zika virus serotypes.

The Zika virus polyprotein of several serotypes usually comprises the sequence arginine-arginine or "RR" at positions 103 and 104 of the polyprotein according to SEQ ID NOs:14 to 26 and 88 to 108. It was found that these positively charged amino acids immediately preceding the native prM signal sequence at position 105 to 125 of the respective polyprotein can help to optimize localization of the resulting Zika virus derived antigen comprising sequence into the membrane and thus the proper assembly of the resulting structural proteins. Therefore, in certain embodiments according to the present invention, the at least one nucleic acid sequence encoding at least one Zika virus antigen will comprise a sequence encoding this RR motif as elucidated in SEQ ID NOs: 53 to 58. In other embodiments, the RR motif can be omitted as shown in SEQ ID NOs:151 and 152.

In a second aspect according to the present invention there is provided a nucleic acid molecule, or an amino acid molecule encoded by the nucleic acid molecule, the nucleic acid molecule comprising at least one nucleic acid sequence, the at least one nucleic acid sequence comprising a first nucleic acid sequence encoding at least one E-protein of a Zika virus or a functional fragment thereof, and a second nucleic acid sequence encoding at least one E-protein signal sequence for a Zika virus E-protein or for a functional fragment thereof, and optionally comprising a third nucleic acid sequence encoding at least one pre-membrane protein of a Zika virus or a functional fragment thereof and optionally comprising a fourth nucleic acid sequence encoding at least one pre-membrane protein signal sequence for a Zika virus pre-membrane protein or for a functional fragment thereof, wherein the first and optionally the second and/or the third and/or the fourth nucleic acid sequence is/are independently derived from SEQ ID NOs: 1 to 13 and 67 to 87, preferably wherein the nucleic acid molecule does not comprise a nucleic acid sequence encoding a C-protein of a flavivirus, and/or preferably wherein the nucleic acid molecule does not comprise a further nucleic acid sequence encoding a non-structural protein of a flavivirus, (a) wherein the nucleic acid molecule additionally comprises a mutation within the first nucleic acid sequence at the position encoding amino acid position L107 of the E-protein of a Zika virus or the functional fragment thereof in comparison to the sequence of SEQ ID NOs:27 to 39, 40 to 52, 109 to 129 or 130 to 150, and optionally wherein the at least one first nucleic acid sequence comprises a sequence encoding the stem anchor region of the E-protein of a Zika virus independently derived from SEQ ID NOs: 1 to 13 and 67 to 87, or wherein the E-protein of a Zika virus comprises a heterologous stem-anchor region selected from any one of SEQ ID NOs: 185 to 191, or a sequence having at least 90%, 91%, 92%, 93%, 94%, 95%, 96%, 97%, 98% or 99% sequence homology thereto, or (b) wherein the nucleic acid molecule does not comprise a nucleic acid sequence encoding a stem anchor region of the E-protein of a Zika virus or a heterologous stem-anchor region for an E-protein of a Zika virus.

The favorable effects of a L107 mutation have been described above.

In another preferred embodiment, no stem-anchor region for an E-protein or a functional fragment thereof is used within the nucleic acid sequences and molecules according to the present invention encoding the antigens and thus the immunogenic compositions according to the present invention. Lacking the membrane anchoring stem-anchor domain, said functional fragments of the E-protein are also referred to as soluble envelope proteins or "sE" proteins herein.

In another embodiment according to the various aspects of the present invention, a heterologous stem-anchor sequence, i.e. a stem-anchor sequence of an organism/virus other than a Zika virus is used for the nucleic acid molecules or the immunogenic compositions according to the present invention.

The nucleic acid molecule according to the second aspect of the present invention preferably comprises a sequence encoding a signal sequence or signal peptide before the E-protein or fragment thereof, or before the prM protein or fragment thereof to allow proper trafficking and localization of the protein or fragment suitable as Zika virus antigen. "Before" in this context implies in 5' direction concerning a DNA sequence, or at the N-terminal position regarding a protein.

According to all embodiments of the present invention, a nucleic acid sequence, also referred to as a second nucleic acid sequence herein, will be used for the production of the immunogenic compositions or will be present for the nucleic acid molecules according to the present invention to provide a suitable targeting of the E-protein of a Zika virus or the fragment thereof after translation within at least one host cell. Said E-protein signal sequence comprises, for example, sequence positions 275 to 290 of SEQ ID NO:14 or the corresponding positions within SEQ ID NOs: 15-26 and 88-108, or the sequences can comprise heterologous signal sequences, or modified signal sequences specifically optimized for a host cell of interest, said host cell ultimately transcribing, translating and processing the nucleic acid molecules and the nucleic acid and amino acid sequences according to the present invention to yield the immunogenic compositions according to the present invention.

Notably, the immunogenic compositions or nucleic acid molecules according to the present invention are not restricted to "homologous" prM or E-protein signal sequences, i.e. a sequence derived from the same organism/ virus, but any suitable "heterologous" signal sequence, i.e. a sequence derived from another organism/virus, can be used, preferably a signal sequence from another Zika virus, or a signal sequence from another virus, preferably a flavivirus other than Zika virus, or a signal sequence derived from a host cell.

A "signal sequence" or "signal peptide" as used herein refers to a sequence usually located at the N-terminus of a pre-protein. In this context, the sequence may also be called "leader sequence/peptide". For certain transmembrane proteins, the signal sequence can also be one of the transmembrane domains ("signal anchor sequence"). The signal peptide after translation is usually a short peptide of about 15 to 30 amino acids that is necessary to target the (nascent) protein towards an organelle or location within a cell, or to the secretory pathway. This targeting is necessary during the development of a virus or virus particle to achieve proper trafficking within a cell. The corresponding signal peptides will thus not necessarily be present in the immunogenic compositions according to the present invention, as the signal sequences/peptides are cleaved off or partially cleaved off during viral or RSP processing within a cell.

Polyprotein processing is important in the regulation of gene expression of many plus-strand RNA viruses, including enveloped, positive-strand RNA flaviviruses and particularly Zika virus. The production from a polyprotein of precursor and mature proteins (cf. FIG. 1 for Zika virus), which may have different functional activities, can be quantitatively and temporally modulated. This involves predominantly the alteration of cleavage specificities of virus-encoded cytoplasmic proteases present in the native viruses. The regulation of a signal peptidase cleavage in the lumen of the endoplasmic reticulum (ER) by a cytoplasmic viral protease has been described for the processing of the structural polyprotein region of several flaviviruses. This is intriguing since signal peptidase cleavages are generally assumed to take place rapidly, during protein translocation across the ER membrane (Stocks and Lobigs, J. of Virol., 1998, vol. 72, no. 3, pp. 2141-2149).

The nucleic acid molecules encoding at least one E-protein of a Zika virus or a functional fragment thereof and preferably also encoding a prM protein or a functional fragment thereof according to the present invention will be preceded, in 5"direction on DNA level, and N-terminal for the corresponding protein, by a suitable signal sequence. The signal sequence is not restricted to the endogenous signal sequence of a given Zika virus used for a construct of interest.

For example, the signal sequence or second nucleic acid sequence for an E-protein of a Zika virus or a functional fragment thereof, will be located upstream of the coding sequence of at least one E-protein of a Zika virus or a functional fragment thereof, or the signal sequence or fourth nucleic acid sequence for an prM-protein of a Zika virus or a functional fragment thereof it will be located upstream of the coding sequence of at least one prM protein or a fragment thereof. The signal sequences and signal peptides disclosed herein can be used interchangeably for all aspects and embodiments according to the present invention. For example, a prM signal sequence can also be used in front (i.e. in 5"direction on DNA level) of a sequence encoding an E-protein or a functional fragment thereof and vice versa. Likewise, two identical signal sequences can be used in front of a sequence encoding in an E-protein or a functional fragment thereof or in front of the sequence encoding a prM protein or a functional fragment thereof according to the present disclosure. The signal sequences can be independently selected from an endogenous signal sequence, or from a signal sequence of another organism, preferably from another virus, more preferably from another flavivirus, e.g. a Japanese encephalitis virus, a yellow fever virus, a West Nile virus, a Dengue virus, a tick-borne encephalitis virus, a cell fusing agent virus, a Palm Creek virus, a Saint Louis encephalitis virus, or a Parramatta River virus or another Zika virus. Notably, the signal sequence suitable according to the present invention are not restricted to originate from a human-specific virus, as the signal sequence can be added in front of the coding sequence of interest to modulate intracellular trafficking and/or secretion purposes, or to enhance immunogenicity for CD8+ T cells (cf. Quinan et al., supra). Suitable sequences are further detailed below and in the attached sequence listing.

Zika virus polyprotein is usually cleaved by host-cell proteases, e.g. signalase and furin (subtilase-like cellular enzyme), as well as the viral NS2B/NS3 protease into the structural proteins C, prM/M and E (see Lei et al., Science, vol. 353, no. 6298, 2016).

Suitable signal sequences, or signal peptides, representing the second and preferably the fourth nucleic acid sequence according to the present invention to be used in front of the coding region encoding either the E-protein of a Zika virus or a functional fragment thereof, and/or in front of the sequence encoding a prM protein or a functional fragment thereof and thus representing a signal sequence "for" an E-protein or a functional fragment thereof, and/or for a prM protein or a functional fragment thereof of a Zika virus can thus be derived from a sequence of the honeybee melittin secretion signal (SEQ ID NO:156, present in pMelBac A, B and C, Invitrogen), a human azurocidin signal peptide (SEQ ID NO:157), a human serum albumin signal peptide (SEQ ID NO:158), a Leukocyte immunoglobulin-like receptor subfamily B member 1 from *Homo sapiens* (SEQ ID NO:159), a bovine prolactin signal peptide (SEQ ID NO:160), a pre-glycoprotein polyprotein GP complex, Lymphocytic choriomeningitis virus (strain Armstrong) signal sequence (SEQ ID NO:161), a human insulin receptor signal peptide (SEQ ID NO: 162), a BM-40 signal peptide from *Drosophila melanogaster* (SEQ ID NO:163), a signal peptide from the glycoprotein of vesicular stomatitis virus (SEQ ID NO:164), a human chymotrypsinogen B signal peptide (SEQ ID NO:165), a human Interleukin-2 signal peptide (SEQ ID NO:166), a *Gaussia princeps* luciferase signal peptide (SEQ ID NO:167, 168), or a signal peptide of Influenza HA (SEQ ID NOs: 169-171), a Hepatitis C Virus (HCV) 1b E1 or E2 signal peptide, or an artificial signal peptide for HCV (SEQ ID NOs: 172-174), a human tissue-type plasminogen activator signal peptide (SEQ ID NOs: 175, 176), or a sequence having at least 85%, 86%, 87%, 88%, 89%, 90%, 91%, 92%, 93%, 94%, 95%, 96%, 97%, 98% or 99% sequence identity to the respective signal sequence. The skilled person can easily define further suitable signal sequences to be used together with a sequence encoding an E-protein or a functional fragment thereof, or a prM protein or a functional fragment thereof, derived from a Zika virus, as those sequences can be identified by sequence analysis and based on data as available for other flaviviruses and relevant host cells or from other organisms suitable for recombinant gene expression. A suitable screening kit to screen the activity of the most suitable signal sequence peptide is provided as Mammalian Signal Peptide Vector Set (Sigma-Aldrich) comprising a PSF-CMV-PURO-NH2-INSULINSP—INSULIN SECRETION PLASMID, plasmid vector for molecular cloning, a PSF-CMV-PURO-NH2-BM40—BM40 SECRETION PLASMID, plasmid vector for molecular cloning, a PSF-CMV-PURO-NH2-VSV G—VSV G SECRETION PLASMID, plasmid vector for molecular cloning, a PSF-CMV-PURO-NH2-CHTP—HUMAN CHYMOTRYPSINOGEN SECRETION PLASMID, plasmid vector for molecular cloning, a PSF-CMV-PURO-NH2-IL-2—INTERLEUKIN-2 SECRETION PLASMID, plasmid vector for molecular cloning, a V—PURO-NH2-GAUS—*GAUSSIA* (LUCIFERASE) SECRETION PLASMID, plasmid vector for molecular cloning, a PSF-CMV-PURO-NH2-ALB—HUMAN ALBUMIN SECRETION PLASMID, plasmid vector for molecular cloning and a PSF-CMV-PURO-NH2-HA/SP—INFLUENZA HA SECRETION PLASMID, plasmid vector for molecular cloning to compare the activity of eight different mammalian secretory tags/signal peptides to identify which most is most effective for the secretion of protein of interest. The most efficient tag will naturally depend on the protein of interest and also on the cells used, as known to the skilled person.

In another particular embodiment, the fourth nucleic acid molecule and/or the second nucleic acid molecule according to the present invention encoding a signal peptide for a prM protein or a functional fragment thereof of a Zika virus can encode a sequence selected from the group consisting of a Murray Valley encephalitis virus prM signal sequence (SEQ ID NO:177), a Yellow fever virus signal peptide (SEQ ID NO:178), a Kunjin virus signal peptide (SEQ ID NO:179), a tick-borne encephalitis virus signal peptide (SEQ ID NO:180), a Dengue virus signal peptide (SEQ ID NO:181), a West Nile virus signal peptide (SEQ ID NO:182), or preferably a Japanese encephalitis signal peptide (SEQ ID NOs: 183, 184), or a sequence having at least 85%, 86%, 87%, 88%, 89%, 90%, 91%, 92%, 93%, 94%, 95%, 96%, 97%, 98% or 99% sequence identity to the respective signal sequence/peptide.

In certain embodiments, signal peptides from a Japanese encephalitis virus can be preferred and can be used in front of a sequence encoding an E-protein or a functional fragment thereof or in front of the sequence encoding a prM protein or a functional fragment thereof as suitable signal sequence, i.e. as the second and/or fourth nucleic acid sequence, according to the present disclosure.

In one embodiment according to the various aspects of the present invention, at least one additional sequence encoding a flaviviral protease, preferably at least one NS2B and/or NS3 protease or a catalytically active fragment or variant thereof of a flavivirus, particularly a Zika virus, may be used and coexpressed together with the nucleic acid molecules according to the present invention to assist in proper processing of the nucleic acid molecules after translation, particularly, if a construct implying a Zika virus derived capsid (C) protein or a functional fragment thereof as further structural protein from a Zika virus is intended for use. The NS2B/NS3 protease complex will cleave a signal peptide for a prM protein of a flavivirus at the N-terminal portion of the signal peptide, whereas a signal peptidase will cleave the signal peptide in the C-terminal portion in front of the prM protein.

Even though the E-protein and to a certain extent also the prM/M protein derived antigens from a Zika virus turned out to be the most promising candidates for vaccination approaches, it might be envisaged, in certain embodiments, to construct a nucleic acid molecule comprising a nucleic acid sequence encoding at least one C-protein derived from a Zika virus, for example, as shown in any one of SEQ ID NOs:14 to 26 and 88 to 108 at amino acid position 6 to 122. In those embodiments, it is preferable that simultaneously a nucleic acid sequence is present encoding the non-structural protein NS2B (amino acid positions 1376 to 1502 of SEQ ID NOs:14 to 26 and 88 to 108) and/or the protease NS3 (amino acid positions 1520 to 1670 of SEQ ID NOs:14 to 26 and 88 to 108). The serine protease NS3 requires NS2B as cofactor and can then process the Zika virus derived polyprotein.

In one embodiment according to the second aspect of the present invention, the at least one nucleic acid molecule, or the amino acid molecule encoded by the nucleic acid molecule, comprises at least one first and optionally a second and/or a third and/or a fourth nucleic acid sequence which nucleic acid sequence(s) is/are selected from the group consisting of SEQ ID NOs: 53 to 56 or 63 and 64 or a sequence having at least 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% sequence homology thereto provided that the homologous sequence after expression still encodes a functional Zika virus antigen.

The Zika virus antigens shown in SEQ ID NOs: 53 to 56 or 63 and 64, originally derived from a sequence according to SEQ ID NO:1 (CDS, GenBank: KU365777.1) or SEQ ID NO:14 (corresponding polyprotein sequence) as derived from Zika virus could be expressed and assembled and, in combination with a suitable vector backbone, provided recombinant constructs having immunogenic activity. Similar results can be obtained when using the highly homologous sequences derived from another Zika virus serotype according to any one of SEQ ID NOs:2 to 13 or 67 to 87 and also any sequence according to Genbank accession numbers KJ776791.1, KU740184.1, KU647676.1, KU720415.1, KU501217.1, KU501216.1, KU365780.1, KU365779.1, KU365778.1, KU365777.1, KU312312.1, KF268950.1, KF268949.1, KF268948.1, KF383119.1, KF383118.1, KF383117.1, KF383116.1, KF383115.1, EU545988.1, DQ859059.1, KU681082.2 or KU681082.3, KU681081.2 or KU681081.3, KU744693.1, KU497555.1, KU707826.1, KU527068.1, NC_012532.1, KU509998.1, KU501215.1, LC002520.1, AY632535.2, KU321639.1, DQ859064.1 or NC_029055.1, or highly homologous Zika virus or Spondweni virus genomes based on the present disclosure.

In preferred embodiments according to the various aspects of the present disclosure, the at least one nucleic acid sequence or the at least one nucleic acid molecule is at least partially codon-optimized.

In a third aspect according to the present invention, there is provided a recombinant chimeric virus comprising a vector backbone as defined in the embodiments of the first aspect of the present invention, and comprising at least one nucleic acid molecule according to the second aspect of the present invention, or comprising at least one nucleic acid sequence as defined in the embodiments of the first aspect of the present invention.

The term "recombinant chimeric virus" as used in this context refers to a virus, which can form part of an immunogenic or vaccine composition, wherein the sequence encoding the virus particles comprising an effective amount of a virus containing E protein or functional fragment thereof derived from a Zika or Spondweni virus serotype and optionally further comprising a structural protein being the prM or a functional fragment thereof and possibly comprising a capsid protein or a functional fragment thereof. This "Zika" portion of the chimeric virus can be derived from any Zika virus. The second part of the chimeric virus, i.e. the vector backbone is chimeric in that sense that it is preferably derived from a non-flavivirus sequence, wherein the non-flavivirus derived sequence preferably comprises at least one attenuating mutation, more preferably, wherein the non-flavivirus derived sequence is a well-characterized vector backbone suitable for vaccination approaches. The use of recombinant chimeric viruses allows the provision of immunogenic, preferably vaccine, compositions which are highly controllable concerning their antigenic and safety profile, which is highly desirable to provide a vaccine preparation safe for use.

In certain embodiments, the recombinant chimeric virus or virus particles represent the immunogenic composition according to the present invention.

In one embodiment according to the third aspect of the present invention, the chimeric virus is encoded by a nucleic acid sequence selected from the group consisting of SEQ ID NOs: 57 or 58, or a sequence of SEQ ID NO: 60 or 192 comprising at least one further nucleic acid sequence, or an amino acid sequence, of SEQ ID NOs: 53 to 64, 27 to 39, 40 to 52, 109 to 129 or 130 to 150, in the case of a nucleic acid sequence the at least one further sequence being inserted between a BsiWI and a BssHII restriction site of SEQ ID NO:60 or of SEQ ID NO:192, or a sequence having at least 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% sequence homology thereto provided that the homologous sequence after expression still encodes chimeric recombinant virus particles.

The recombinant virus particles can optionally comprise VLPs or RSPs. Therefore, the recombinant virus particles can comprise both infectious and non-infectious virus or virus-like or subviral particles.

It is known to the skilled person that a given vector backbone, particularly a vector backbone having dimensions as shown in SEQ ID NOs:60 or 192, can tolerate certain mutations without effecting the function or virulence characteristics of the encoded virus. Therefore, said silent or tolerable mutations can be introduced into a vector backbone, but no mutations are comprised by the above presented sequence homology range which would comprise a mutation in a region of the virus vector backbone encoded genome, which would disturb its natural replication cycle, or which would revert the attenuated virus scaffold back into a non-attenuated virus form. Said sequence homology range is thus caused by the fact that a virus vector backbone can, by means of recombinant technology, comprise codon optimized positions (in theory, one in three DNA nucleotide positions could thus be optimized to provide a sequence still encoding the same amino acid sequence than a non-codon optimized sequence), further regulatory or antigen positions and the like. Said modifications, however, would still lead to a recombinant infectious chimeric virus particle comprising at least one functional Zika virus antigen and are thus comprised by the present disclosure.

In another embodiment, the recombinant virus, or the chimeric virus can comprise a sequence according to any one of SEQ ID NOs: 53 to 56 or 61 to 66 or a sequence having at least 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% sequence homology thereto provided that the homologous sequence, optionally after expression still encodes (chimeric) recombinant virus particles.

In a further aspect, there is provided a host cell comprising at least one nucleic acid molecule, or comprising at least one nucleic acid sequence, or comprising at least one recombinant chimeric virus according to the present disclosure.

In a further aspect according to the present invention there is provided a method for producing a recombinant chimeric virus according to the third aspect of the present invention, or for producing an immunogenic composition according to the first aspect of the present invention, the method comprising the following steps: (i) inserting at least one nucleic acid sequence as defined in for the first aspect of the present invention, or inserting at least one nucleic acid molecule according to the second aspect of the present invention into a vector backbone as defined for the first aspect of the present invention to operably link the nucleic acid sequence or molecule and the vector backbone to obtain a recombinant chimeric virus sequence; (ii) infecting at least one host cell with at least one recombinant chimeric virus sequence obtained in step (i) to obtain a virus sample; (iii) optionally: clarifying the virus sample of step (ii); (iv) optionally: purifying the clarified virus sample of step (iii); (v) optionally: formulating the at least one recombinant chimeric virus with at least one pharmaceutically and/or veterinarially acceptable carrier and/or excipient; (vi) obtaining a recombinant chimeric virus, or an immunogenic composition.

"Obtained" or "obtaining" in the context of obtaining purified virus particles this means that the respective particles can be directly obtained from a chromatographic step without any further processing, purification or polishing steps, whereas such further downstream steps are not excluded according to the methods of the present invention. Said further downstream processing can comprise additional purification, chromatographic or by filtration, polishing, buffer exchange and the like to achieve either differential fractionation of desired compounds, to yield even higher purities, or to provide the such purified product in a suitable buffer system.

The term "infectious" according to the present disclosure implies that the infectious virus particles after production in a host cell, preferably a host cell, or cell population comprising more than one host cell of interest carry all necessary molecules and are assembled in a way so that they are able to reinfect another cell population, host cell or subject of interest. Preferably, the infectious virus particles, optionally comprising virions and/or non-replicating virus-like particles (VLPs), or non-replicating recombinant subviral particles (RSPs), or a mixture thereof, as obtained by the methods according to the present invention are suitable as immunogenic or as vaccine compositions as directly obtained by the methods disclosed herein. As the vector backbones according to the present invention are no wild-type virus vector backbones, but rather highly modified, tested and attenuated vector backbones, the term "infectious" mainly describes the capability of a resulting virus particle to enter a host cell as mediated by its surface expressed viral derived proteins being able to interact with receptor and recognition molecules on a host or target cell, whereas the recombinant and modified virus due to extensive modifications and attenuation will not cause disease symptoms as the wild-type virus it is derived from. As further detailed above, VLPs and/or RSPs lack genetic information and are thus non-replicative. As said particles comprise structural proteins derived from a native virus on their particle surface and said structural proteins, or antigens thereof, can interact with cells and receptors within a host cell, also VLPs and/or RSPs can interact with a cell of the adaptive and/or innate immune system of a subject, or they can be taken up by a host cell to induce an immune response.

The term "encoding" in connection with a nucleic acid sequence encoding a recombinant infectious or chimeric virus particles according to the present invention means that the nucleic acid sequence provides the genetic information for the transcription and for polypeptides also the translation of the Zika virus derived antigens and a vector backbone operably linked thereto. Naturally, the chimeric virus particles can contain further material, e.g. in their envelope as being released from a host cell after budding from the cell membrane, which material is derived from the host cell.

The term "clarified" or "clarification" according all aspects of the present disclosure refers to a step for removing large product or process related impurities from a bulk product to be clarified. For the purpose of the present invention, the bulk product can be the recombinant chimeric virus particles and/or the VLPs and/or the RSPs produced in and released from a cell population or from a host cell. Clarification thus only aims at removing cells and cell-debris from the host cells infected with and producing a virus. Clarification does not imply a specific separation of the analyte, i.e. the chimeric virus or virus particles or virus-like particles or recombinant subviral particles, with the aim of achieving high purity to eliminate further product- and process related impurities. Common methods for clarification are centrifugation and microfiltration, including tangential flow filtration, ultracentrifugation, filtering by filter cartridges and the like, which are both familiar to the skilled person in the relevant field. In the context of clarifying a bulk product comprising recombinant infectious virus particles derived from a measles virus scaffold it has to be noted that centrifugation should be avoided, as centrifugation processes are not easily scalable under GMP conditions or there is an increased risk of contamination of the desired product. Therefore, according to one embodiment of the second aspect of the present invention, there is provided a method according, wherein the clarification is performed by a method other than centrifugation, preferably, wherein clarification is performed by a filtration method, including inter alia depth filtrations or membrane filtration. Using filtration or any clarification technique relying on adsorption as separating principle a filter material should be chosen, which does not show unspecific binding or modification of the infectious measles virus particles.

In one embodiment according to the above method, there is provided a method further comprising a purification step (iv), wherein the purification step comprises purification by means of chromatography, optionally, wherein purification is followed by an additional polishing step.

In one embodiment of all aspects according to the methods of the present invention, a purification step results in viral products having a reduced content of other process related impurities. Such process related impurities comprise, but are not limited to host cells, cell debris, protein contaminants, either resulting from cell culture additives or from enzymes added during cultivation and processing, a microcarrier used for host-cell cultivation, or foreign nucleic acids neither belonging to the host cell nor the recombinant infectious virus or particles thereof of interest.

The method according to the above aspect can comprise an incubation step to incubate the infected at least one host cell at a temperature in the range of 32.0° C.+/−4° C., preferably at a temperature in the range of 32.0° C.+/−1° C. with at least one recombinant chimeric virus sequence to obtain a virus sample, wherein a virus sample represents recombinant chimeric virus particles as expressed and released from the host cell, wherein the virus sample can comprise infectious virus particles and/or VLPs and/or RSPs.

A "virus sample" as used herein thus refers to a sample obtainable from an infected host cell during the various steps of the methods according to the present application. The term can thus refer to a sample obtained from the supernatant, or a sample obtained from the lysate of a cell. A virus sample can be used for further clarification and/or purification as disclosed herein or for the purpose of analysis, e.g. for determining the correct sequence of a transcribed virus genome or for the analysis of virus virions and/or virus-like particles and/or recombinant subviral particles.

According to embodiments using purification, the purified recombinant chimeric virus particles are usually obtained in one or more fractions corresponding to the product peak of the chromatography elution step. The concentration of contaminating DNA as referred to in the following thus refers to the concentration of DNA detected within 1 mL of a fraction comprising the purified recombinant infectious virus particles derived from a measles virus scaffold. In case, there is more than one product peak of the chromatography elution step comprising the purified recombinant chimeric virus particles derived from a measles virus scaffold, the concentration of less than 33.33 ng/mL, or preferably less, of contaminating host cell DNA is pertinent for each of the individual fractions.

Depending on the host cell of interest, the intended multiplicity of infection (MOI) used for infection with a recombinant chimeric virus particle of interest can vary as it is known to the skilled person in the field of virology. The MOI usually depends on the Tissue culture infective dose (TCID). Alternative methods for the TCID method are a plaque assay, an immune focus assay or quantitative PCR (qPCR). The $TCID_{50}$ as used herein refers to median tissue culture infective dose, i.e. the amount of a pathogenic agent that will produce pathological change in 50% of cell cultures inoculated. An appropriate $MOI/TCID_{50}$ can be determined following common tests, e.g. the Kärber method or the Reed Muench method.

In certain embodiments, suitable host cells for the propagation and production of recombinant chimeric virus material according to the present invention are selected from the group consisting of Vero cells, chicken embryo fibroblast cells, HEK293 cells, HeLa cells, fetal rhesus lung cells or MRC5 cells. The skilled person can easily define further suitable host cells depending on the vector backbone used in accordance with the present disclosure.

In certain embodiments according to the above method of the present invention, there is further provided a method additionally comprising a further purification step, comprising: further purifying the recombinant virus or the recombinant chimeric virus or the immunogenic composition, i.e. the pharmaceutically active virus constituent thereof, by means of filtration, centrifugation, tangential flow filtration, membrane filtration, purification with grafted media, aqueous two phase extraction, precipitation, buffer exchange, dialysis or chromatography, including size exclusion chromatography for separating the purified recombinant infectious virus particles derived from a measles virus scaffold into a fraction containing virions and another fraction containing virus-like particles or recombinant subviral particles. Said embodiment is especially useful in case the antigenic region inserted as nucleic acid sequence into an attenuated vector backbone, preferably a measles virus derived vector backbone has to be further separated into a fraction containing the replication competent virions of the measles virus containing genetic material, and the VLPs and/or RSPs self-assembled from the antigens of the at least one Zika virus, wherein the VLPs and RSPs are devoid of any genetic material. Therefore, they posses relevant surface antigens, but cannot further be propagated in a host cell, which makes VLPs and RSPs an interesting target for several applications in immunology.

In yet a further embodiment according to the above method, the method comprises a further step, comprising (vii) separating recombinant subviral particles from infectious particles.

In one embodiment there is further provided a method additionally comprising a further polishing or buffer-exchange step, comprising: further purifying and/or polishing a recombinant infectious virus particles derived from a measles virus scaffold or subjecting a recombinant infectious virus particles derived from a measles virus scaffold to a buffer-exchange by means of filtration, centrifugation, tangential flow filtration, membrane filtration, purification with grafted media, aqueous two phase extraction, precipitation, buffer exchange, dialysis or chromatography, including size exclusion chromatography for further polishing the virus particles or for providing a suitable buffer exchange possibly necessary for the downstream manufacture of a desired product. Such an additional step of polishing or buffer-exchange is furthermore especially suitable to further decrease the amount of process-related DNAses or serum proteins used during the manufacturing process of the virus particles derived from a measles virus scaffold according to the present invention and thus to achieve a higher degree of purity in terms of protein contaminants in the purified recombinant infectious virus particles and in an immunogenic or a vaccine composition obtainable therefrom. Additionally, said step can be applied to further separate VLPs or RSPs from the recombinant infectious chimeric virus particles, preferably comprising a measles virus scaffold and at least one Zika virus antigen.

All nucleic acid molecules according to the present disclosure can optionally be codon optimized. This implies that the codon usage of a given nucleic acid sequence can be modified to be compatible with the codon usage of a host cell of interest to allow better transcription rates, mRNA processing and/or stability, and/or translation rates, and/or protein folding and thus the expression of functional amino acid sequences in a host cell of interest. The person having skill in the art in the knowledge of the genetic code and the codon usage of a target host cell can easily adapt a nucleic acid molecule according to the present disclosure without effecting a change in the resulting amino acid sequence after translation. Therefore, codon optimized sequences of the nucleic acid molecules according to the present invention are also comprised by the present disclosure.

In a particular embodiment of the present invention, the immunogenic construct is prepared by cloning a polynucleotide sequence encoding at least one structural protein or a plurality of structural proteins derived from a Zika virus serotype in the cDNA encoding the full-length antigenomic (+) RNA of an attenuated measles virus. Alternatively, a nucleic acid construct of the invention may be prepared using steps of synthesis of nucleic acid fragments or polymerization from a template, including PCR. The at least one polynucleotide or nucleic acid sequence encoding the at least one protein of at least one Zika virus is then cloned into an ATU (Additional Transcription Unit) inserted in the cDNA of the measles virus. Usually, there is one ATU per construct. ATU sequences usually comprise three potential regions of inserting a nucleic acid and further comprise, for use in steps of cloning into cDNA of MV, cis-acting sequences necessary for MV-dependent expression of a recombinant transgene, such as a promoter preceding a gene of interest, in MV cDNA, the insert represented by the polynucleotide encoding the viral protein(s) inserted into a multiple cloning sites cassette. The ATU is advantageously located in the N-terminal sequence of the cDNA molecule encoding the full-length (+)RNA strand of the antigenome of the MV, for example before the N gene (ATU1), and, for the purpose of the present disclosure, it is preferably located between the P and M genes of this virus (ATU2). Alternatively, it can be located between the H and L genes (ATU3). One exemplary construct comprising an ATU3 and an insert, in this case a green fluorescent protein (GFP) encoding gene, cloned within the ATU3 can be derived from SEQ ID NO:153. At position 9333 to 9338 of SEQ ID NO: 153, there is located a BsiWI restriction site representing the 5"cloning site for a heterologous gene of interest, preferably at least one gene or fragment thereof encoding at least one Zika virus antigen. At position 10059 to 10064 of SEQ ID NO: 153, there is located a BssHII restriction enzyme site representing the 3"cloning site for a heterologous gene of interest, preferably at least one gene or fragment thereof encoding at least one Zika virus antigen. An insert of interest can thus be positioned within the ATU3 cloning site (position 9339 to 10058, including an ATG start and a TAG stop codon, respectively, in SEQ ID NO:153 exemplary showing a GFP insert) as further alternative to cloning into an ATU2 or an ATU1 site. It has been observed that the transcription of the viral RNA of MV follows a gradient from the 5' to the 3' end. This explains that, when inserted in the 5' end of the coding sequence of the cDNA, the ATU will enable a more efficient expression of the heterologous recombinant nucleic acid DNA sequence. The ATU sequence can, however, be located at any position of SEQ ID NO:59 provided that it does not disrupt a coding sequence or a regulatory sequence thereof.

Furthermore, according to any aspect of the present invention, the disclosed nucleic acid molecules can be further modified by means of molecular biology to introduce a new or a modified regulatory sequence, restriction enzyme binding/cutting site as well as various nucleic acid sequences encoding an antigenic region of interest, preferably respecting the above identified "rule of six". This rule was established for certain viruses belonging to the Paramyxoviridae family where the measles virus vector of the present disclosure phylogenetically is derived from/ belongs to. This rule is thus derived from the fact that in order for the entire process of RNA synthesis, genome replication and encapsidation which the measles virus proceeds through in a host cell to be efficient at generating full-length genomic and antigenomic molecules it is necessary that the viral genome is enclosed within its protein coat, specifically the N proteins. Without this, the virus replication machinery will find problems to begin replication. Each N molecule associates with exactly 6 nucleotides, which explains the reason as to why these viruses require their genomes to be a multiple of six. It is thus evident that a variety of modifications of the measles virus scaffold can be undertaken with the proviso that it still results in a measles virus scaffold able to infect a host cell. Therefore, means like codon optimization and the like can be applied as long as no mutation introduced which would change the functional properties of a regulatory sequence or a structural protein of the measles virus. Furthermore, in the case of virions comprising genetic material, it has to be ensured by sequencing that the resulting purified recombinant infectious virus particles derived from a measles virus scaffold do not comprise a mutation rendering the attenuated virus virulent again. Such methods of nucleic acid sequencing, including deep sequencing, for means of sequence confirmation belong to the common general knowledge of the skilled person in the field of molecular biology and virology and can be applied at any stage of the methods according to the present disclosure.

The same holds true for VLPs or RSPs which may not comprise potentially harmful mutations in the sequences encoding for their structural proteins, i.e. the Zika virus antigens according to the present invention. VLP or RSP formation can inter alia be monitored by means of electron microscopy. To this end, for example, supernatants from infected cells, e.g. Vero cells, can be collected after 36 h of infection with an MOI of 0.0001 to 1, preferably with an MOI of 0.0001 to 0.1, after infection with a construct comprising SEQ ID NOs:57 or 58. The supernatants are then clarified by centrifugation at 3000 rpm for 30 min, layered on 20% sucrose cushion in PBS and centrifuged at 41,000 rpm for 2 h in a SW41 rotor. Pellets are next resuspended in PBS with 1% BSA and analysed by electron microscopy. Negative staining is conducted by 2% uranyl acetate on copper grids coated with carbon and glow discharged just before use. The samples can be observed at 80 kV with a Jeol JEM1200 (Tokyo, Japan) transmission electron microscope. Images were recorded using an Eloise Keenview camera and the Analysis Prosoftware version 3.1 (Eloise SARL, Roissy, France).

In one embodiment according to the above method of the present invention, the virus sample is treated with a DNAse, preferably with a benzonase, a DNAse endonuclease genetically engineered *Serratia*, either before or after the clarification. In one embodiment, the DNAse treatment is performed before the clarification step. In another embodiment, the DNAse treatment is performed with a clarified virus sample comprising recombinant infectious virus particles derived from a measles virus scaffold. Said step fulfills two functions: first of all, unwanted nucleic acids in the form of DNA can be cleaved to allow a more efficient removal of DNA during the further purification. Secondly, the virus sample which can be obtained from this treatment reduces the viscosity of the resulting material. Said lower viscosity results in an enhanced performance of the material in chromatography, as the material otherwise would easily clog a column comprising the stationary phase of interest.

In one embodiment according to the above method of the present invention, no DNAse treatment is conducted.

Chromatography refers to a separating principle or a procedure in which a biological or chemical mixture of substances comprising an analyte carried by a liquid or a gas is separated into its components as a result of differential distribution of the solutes between a stationary and a mobile phase, as they flow around or over a stationary liquid, gel or solid phase as stationary phase. Passing through the stationary phase leads to a retention of the analyte depending inter alia on the interaction between the analyte and the stationary phase and its diffusion characteristics as dictated by the chemical and physical properties of the analyte. For the purpose of the present invention, the analyte is represented by the recombinant infectious virus particles derived from a measles virus scaffold. Given the above outlined genome size of the measles virus scaffold and the resulting huge particle size of 100 to up to 1000 nm for the enveloped virus and the physicochemical properties of the infectious virus particles or the virus-like particles derived from the measles virus scaffold, so far no efficient chromatography based approach exists for purifying measles virus derived infectious virus particles. Attempts to purify the measles virus or a measles virus scaffold derived virus particle were accompanied by huge loss of the material to be purified so far and could not be conducted at an industry grade under GMP conditions.

In one embodiment according to the various aspects of the present disclosure, the purification by means of chromatography is performed using a stationary phase, preferably a stationary phase having a monolithic arrangement, wherein the stationary phase has a pore size of at least 5 µm, preferably a pore size of at least 6 µm, and more preferably a pore size of at least 7 µm, or wherein the purification by means of chromatography is performed using a stationary phase having a monolithic arrangement, wherein the mode of adsorption is hydrophobic interaction.

In the field of chromatography, it is known to the skilled person that the stationary phases, especially in the context of the purification of a virus, can consist of pre-packed porous beds, a matrix consisting of membrane adsorbers or can have a monolithic arrangement. For all different kinds of stationary phases, several separation modes or modes of adsorption exist being classified according to their principle of interaction and/or separation of the analyte to be separated/purified. Said modes include affinity chromatography, ion exchange chromatography, including cation and anion exchange chromatography, hydrophobic interaction, size exclusion, or a combination thereof. Concerning the methods according to the present invention, membrane adsorbers and even more preferably monolithic stationary phases are especially advantageous, as they show a high binding capacity as well as a high possible flow rate. In addition, low pressure has to be applied. This makes the methods according to the present application especially suitable for large and/or enveloped viruses.

In one embodiment according to the method of the present invention, the chromatography is based on convective chromatography techniques, including a monolithically arranged stationary phase or a membrane adsorber as stationary phase. This allows the purification of recombinant infectious chimeric virus particles, optionally comprising virions and/or virus-like particles and/or RSPs, even for sterically demanding particles of huge viruses having a large diameter, or for particles having peculiar surface characteristics. Furthermore, said specific stationary phases provide improved characteristics regarding their capacity, resolution, the yield of the virus product to be purified and the high possible flow rates. In one embodiment according to the present invention, the step of purifying the recombinant infectious chimeric virus particles by means of chromatography after clarification is performed by using a hydrophobic interaction approach. Said strategy for purifying the crude virus sample obtained after clarification is especially suitable for particles derived from a measles virus scaffold, as other modes of separation like ion exchange, might not be suitable or might require a tedious process optimization for measles virus scaffold based infectious virus particles, as the huge measles virus derived virus particles, the virions and/or the virus-like particles derived therefrom and their isoelectric point as well as the huge surface area of a virus reactive groups associated therewith is prone to lead to unspecific interactions in case a ion exchange mode is used for interaction hampering an efficient purification, wherein the loss of virus material has to be as low as possible. One exemplary suitable monolithic stationary phase is provided in a CIMmultus™ column (BIA separations) with an optimized pore size of at least 4 µm, preferably of at least 5 µm, and more preferably of at least 6 μm. One possible ligand defining the purification mode and thus the surface chemistry of the monolithic stationary phase is a OH-ligand, whereas the resulting OH monoliths are very hydrophilic due to the high density of the hydroxyl groups, which makes them suitable in a hydrophobic interaction purification approach of the infectious virus particles derived from a measles virus scaffold according to the methods of the present invention.

In one embodiment, ion exchange chromatography can, however, be used to purify virus-like particles or recombinant subviral particles obtainable according to the methods of the present invention. Due to the smaller overall size of VLPs or RSPs and their defined surface characteristics, ion exchange chromatography and also size exclusion chromatography, and a combination or mixture thereof in the form of several chromatographic steps, can be used to purify those non replicating particles according to the present invention comprising at least one Zika virus derived antigen.

In another embodiment of the present invention, size exclusion chromatography as mode of interaction is used to separate the clarified virus stock, wherein the pore size of the stationary phase material is at least 5 μm, preferably at least 6 μm, and more preferably a pore size of at least 7 μm.

In another embodiment of the present invention directed to the further purification of VLPs or RSPs, size exclusion chromatography as mode of interaction is used to separate the clarified virus stock, wherein the pore size of the stationary phase material is less than 5 μm, preferably less than 4 μm, more preferably less than 3 μm.

In a further embodiment according to the method of the present invention, size exclusion, ion exchange or hydrophobic interaction chromatography is used to further purify the recombinant infectious chimeric virus particles based on a measles virus vector backbone and comprising at least one functional Zika virus antigen after a first chromatographic purification. Other purification methods like tangential flow filtration, purification with grafted media, aqueous two phase extraction or precipitation are also possible. Said modes of purification are especially suitable to further decrease the amount of process-related DNAses or serum proteins used during the manufacturing process of the virus particles derived from a measles virus scaffold according to the present invention and thus to achieve a higher degree of purity in terms of protein contaminants in the purified recombinant infectious virus particles and in an immunogenic or a vaccine composition obtainable therefrom. Alternatively, according to another embodiment of the present invention, the second purification step to further remove process-related protein contaminants is conducted by tangential flow filtration. Preferably, the level of contaminating process-related total protein contaminants in the purified sample, i.e. in the at least one fraction comprising the infectious virus particles, directly obtained from the first chromatographic step according to the present invention is below 1 ng/mL, more preferably it is below 100 pg/mL, even more preferably, it is below 10 pg/mL, and most preferably, it is below 1.1 pg/mL.

In yet another embodiment according to the present invention, affinity chromatography is used to purify the recombinant infectious virus particles derived from a measles virus scaffold as second chromatography step. Said embodiment is especially suitable in case an antibody binding an antigen expressed and presented on the recombinant infectious virus particles is present, or where a tag has been fused and thus operably linked to the nucleic acid sequence encoding surface exposed parts of the recombinant infectious virus particles.

The person skilled in the art is aware that several columns and chromatography systems exist which are suitable to conduct the methods using the separation techniques and stationary phases as detailed herein.

In a further embodiment according to the above method, the at least one host cell is selected from the group consisting of Vero cells (African green monkey derived kidney cells), chicken embryo fibroblast cells, HEK293 cells (human embryonic kidney cells), or any derivative thereof, HeLa cells (*Homo sapiens* derived cervix epithelial cells), fetal rhesus lung cells or MRC5 cells (*Homo sapiens* derived lung fibroblast cells). Vero cells, e.g. the WHO reference cell line Vero RCB 10-87 established in 1987 and subjected to a broad range of tests to establish its suitability for vaccine production or ATCC-CRL1587™, chicken embryo fibroblast cells, e.g. ATCC® CRL-12203™, HEK293 cells, e.g. ATCC® CCL-1573™, HeLa cells, e.g. ATCC® CCL-2™ or ATCC® CCL-2™, or MRC5 cells, e.g. ATCC® CCL-171™. In principle, any cell line is suitable for the purpose of the present invention as long as it can be infected with a recombinant chimeric virus according to the present disclosure and as long as it supports a replication cycle thereof. Preferably, the cell population comprising at least one cell or the at least one host cell are recombinant, as a host cell represents a standardized and well characterized material which are indispensable prerequisites for certain GMP approaches and concerning safety issues. It is further known to the skilled person that certain cell lines require permission to release, e.g. from the WHO, if they are intended for the production of a vaccine or a biological, or for the development of new candidate vaccines or biologicals following the FDA requirements. Said permission can be obtained by the relevant authorities as it is known to the skilled person. The cell population or the at least one host cell used for the purpose of the present invention, for example as master cell bank, will only be used until a certain number of passages is achieved to avoid the risk of a cell line to accumulate mutations which renders it potentially tumorigenic. Preferably, the number of cell passages will thus not exceed 170, preferably not exceed 160, more preferably not exceed 155, and most preferably not exceed 150 passages.

Further cells suitable to produce an immunogenic composition or recombinant chimeric virus particles according to the present invention can be used, as long as those cells are susceptible to the respective vector backbone of the chimeric virus and promote transcription and possibly translation of the nucleic acid sequences comprised by a recombinant chimeric virus according to the present invention and subsequently the formation of recombinant chimeric viral particles comprising at least one Zika virus antigen, which is suitable as immunogenic composition.

In a further aspect according to the present invention there is provided an immunogenic composition, preferably a vaccine composition, comprising an immunogenic composition according to the first aspect of the present invention, or comprising at least one nucleic acid molecule according to the second aspect of the present invention, or comprising at least one recombinant chimeric virus according to the third aspect according to the present invention, for use in a method of preventing or treating a Zika virus disease in a subject.

According to this aspect of the present invention there is thus provided a therapeutic method, comprising a prophylactic and/or therapeutic method, wherein an immunogenic composition according to the first aspect of the present invention, or a nucleic acid molecule according to the second aspect of the present invention, or a recombinant chimeric virus according to the third aspect according to the present invention is used to induce an immunological response in a subject for preventing or treating a Zika virus disease in said subject upon administration by a single dose schedule or a multiple dose schedule.

In one embodiment, the immunogenic composition or the vaccine composition for use in a method of preventing or treating a Zika virus disease is characterized by a content of contaminating host cell DNA of less than 100 pg/dosis, preferably of less than 75 pg/dosis, more preferably of less than 50 pg/dosis, even more preferably of less than 25 pg/dosis and most preferably of less than 10 pg/dosis, wherein one dosis represents one dosis comprising the immunogenic or the vaccine composition to be administered to a subject in need thereof as a single dose.

As detailed above, besides the provision of suitable Zika virus antigens for eliciting an antibody or an immune response against a Zika virus derived epitope, the purity of an immunogenic or a vaccine composition is of great importance to provide an immunogenic composition which is safe for use. Based on the methods herein an immunogenic composition comprising at least one Zika virus antigen can contain less than 30 ng/mL, preferably less than 20 ng/mL, more preferably less than 10 ng/mL, even more preferably less than 1 ng/mL, even more preferably less than 100 pg/mL, even more preferably less than 10 pg/mL and most preferably less than 1.1 pg/mL of contaminating host cell DNA per one mL of the recombinant chimeric virus particles as directly obtained within at least one fraction after chromatographic purification with respect to 1 mL of one of the at least one fraction. The term directly obtained after chromatographic purification implies the degree of purity obtained in the sample as directly obtained without any further concentration or filtration steps after collecting the product peak from the chromatography step.

As a matter of course, the level of contaminating host cell DNA or the level of other process- or product related impurities is even lower, at least by a factor of 1 to 10 depending inter alia on the efficiency of the production process and the final titer chosen for application, and, therefore, the level of contaminating DNA or proteins or other materials in an immunogenic or a vaccine composition is naturally even lower. As detailed in the Background of the Invention, currently, the WHO defines a limit of 10 ng/dosis of a drug vaccine composition to be administered to a subject, whereas the former limit of 100 pg/mL was increased to the 10 ng/ml threshold, as many manufactures of virus compositions, especially in the context of live attenuated viruses like measles, mumps and rubella could not consistently guarantee such a low level of contaminating host cell DNA. The immunogenic or vaccine composition as provided herein and as purified according to the methods of the present invention allows the provision of a drug composition, which even has a degree of contaminating host cell DNA of below 100 pg/dosis or even lower and, most preferably even below the current detection limit for DNA achievable by presently available detection methods, which currently is in the single-digit pictogram range depending on the material to be analyzed and the quantitative method used, including PCR; enzyme-based and luminescence based assays. For the purpose of the present invention given the detection system used herein at the date of this invention, said detection limit for DNA is 1.1 pg/mL.

Methods to determine the concentration of contaminating host cell DNA are known to the person having skill in the art. Said methods rapidly advance and thus the limit of quantification (LOQ: amount of target DNA that maximizes the sum of sensitivity and specificity) and the limit of detection (LOD: lowest amount of target DNA which can be amplified with a false-negative rate below a given threshold) for a sample of interest are getting improved rapidly. Therefore, nowadays much more precise quantification of process- and product related impurities/contaminants are possible than 20 years ago. A standard method for detecting small amounts of contaminating DNA in a sample is quantitative real-time PCR (qPCR or qRT PCR) (e.g. PicoGreen® assay (Life Technologies)). Another method for detecting contaminating DNA or proteins in a sample of interest are threshold DNA assays (e.g. Threshold® Immunoligand Assay (ILA) or Threshold® Total DNA Assay Molecular Devices). Said methods both show a high sensitivity and a good detection limit in the pictogram range and are readily available to the skilled person. Likewise, methods for performing a quantification of total protein, or of specific proteins contained as contaminants in a sample or in an immunogenic or a vaccine composition comprising the purified infectious virus particles derived from the measles virus scaffold can be quantified by methods readily available to the skilled person. Said methods, inter alia, include a BCA (bicinchoninic acid) assay or a Vero cell host cell protein (HCP) ELISA assay (Cygnus Technologies, current detection limit as declared by the manufacturer: 700 pg/mL) or other enzyme and/or fluorescence based methods. Said methods are readily available to the skilled person.

Furthermore, it is an advantage of the methods according to the present invention and the products which can be obtained therefrom that in principle no further processing or concentration is necessary after the chromatography step which is advantageous as every further step would intrinsically be prone to a loss of virus material and would have to be performed under GMP conditions. Moreover, the methods according to the present invention and the products which can be obtained therefrom are provided in a high yield and in active form from the chromatography step allowing, if intended, a further purification step, for example, in case a further separation of infectious virions and infectious virus-like particles, if present, from the pool of purified infectious virus particles, or a further decrease of product- and process-related impurities is desired, for example during an additional purification, polishing or buffer-exchange step.

In certain embodiments, at least one Zika virus antigen encoding sequence carry at least one tag enabling a purification via affinity chromatography either as first chromatographic purification step or as an additional purification step or for analytical purposes. Suitable tag-sequences are known to the skilled person.

Methods and means for cultivating a host cell according to the present disclosure which allow the viability of the respective host cell and which allow the introduction, maintenance and transcription, translation and possibly secretion of the vectors, nucleic acid and amino acid molecules disclosed herein are well known to the person having skill in the art.

Suitable reaction conditions as referred to herein, including inter alia buffers, including buffer composition and pH, additives, temperature- and pH-conditions, reaction times and the like can be readily determined by the skilled person in knowledge of the disclosure provided herein. Said conditions may naturally vary depending on the host cells of the cell population chosen for infection, whereas the disclosure provided herein provides a guidance for setting and determining said reaction conditions.

The immunogenic composition according to the present invention usually comprises at least one pharmaceutically and/or veterinarially acceptable carrier and/or excipient. An immunogenic composition in this context is any composition eliciting an immune response in a subject.

A carrier according to the present disclosure is a substance that aims at improving the delivery and effectiveness of a drug composition, usually without being a medical ingredient. Carrier materials may depend on the physical state of a drug composition to be administered. Typically, immunogenic or vaccine compositions are administered as liquid solution. Therefore, particularly for immunogenic compositions comprising a recombinant virus or a VLP/RSP, a carrier implies a suitable buffer, comprising a suitable composition, e.g. salts and pH, which are necessary to stabilize the recombinant virus or VLP/RSP. Suitable substances are well known to those in the art and include, large, slowly metabolized macromolecules, such as proteins, polysaccharides, polylactic acids, polyglycolic acids, polymeric amino acids, amino acid copolymers, and inactive virus particles. Pharmaceutically and veterinary acceptable salts can also be used in the immunological composition, for example, mineral salts such as hydrochlorides, hydrobromides, phosphates, or sulfates, as well as the salts of organic acids such as acetates, propionates, malonates, or benzoates. Immunological compositions can also contain liquids, such as water, saline, glycerol, and ethanol, as well as substances such as wetting agents, emulsifying agents, or pH buffering agents. Furthermore, nanocarriers, including liposomes, also can be used as carriers. Depending on the nature of the at least one immunogenic or the vaccine composition used and dependent on the immune response, which is intended to be provoked, such a composition can additionally comprise an adjuvant and further pharmaceutically and/or veterinary acceptable carriers. Furthermore, an immunogenic or a vaccine composition according to the present disclosure can comprise more than one active ingredient in the form of an antigen. Numerous further pharmaceutically acceptable solutions for use in vaccine preparation are well known and can readily be adapted for use in the present invention by those of skill in this art (see, e. g., Remington's Pharmaceutical Sciences (18th edition), ed. A. Gennaro, 1990, Mack Publishing Co., Easton, Pa.).

An excipient is a substance included in a drug composition, including an immunogenic or a vaccine composition, which is added for the purpose of long-term stabilization, bulking up solid formulations that contain active ingredients, including, for example, infectious virus particles, or to confer a therapeutic enhancement on the active ingredient in the final dosage form, e.g. for improving the absorption, modifying the viscosity or for enhancing solubility. Common excipients include, but are not restricted to, antibiotics added to prevent the growth of bacteria within the vials of the vaccine during production and storage of the vaccine. For example, neomycin and/or polymyxin B can be used in the manufacture of vaccines such as measles mumps-rubella vaccine. Furthermore, an excipient can also be a stabilizer like monosodium glutamate (MSG) and 2-phenoxyethanol, which increase the shelf life of the vaccine, i.e. they protect the vaccine from heat, light, acidity, or humidity. Further excipients can include additives including lactose, sorbitol and sucrose, glycine and human or bovine (cow/calf) serum albumin and MSG. Furthermore, preservatives and diluents can be comprised by an immunogenic or a vaccine composition. The skilled person can easily find suitable substances for preparing an immunogenic or a vaccine composition according to the present invention suitable as excipient in its broadest sense (see, e.g. Remington supra or Remington: Remington: The Science and Practice of Pharmacy, ed.

2012). Gelatin, which is partially hydrolysed collagen, usually of bovine (cow) or porcine (pig) origin, is added to some vaccines as a stabiliser.

A prophylactic treatment as referred to herein in the context of vaccine compositions means a treatment which mediated a protective immune response in a subject vaccinated so that there are no or less severe symptoms, when the subject after having been vaccinated and after having developed an immune response to the vaccine composition will encounter an infection with the non-attenuated wild-type strain of a virus antigens of which are present in the vaccine composition.

A therapeutic treatment, for example, implies that the immunogenic or the vaccine compositions according to the present invention are used to generate neutralizing antibodies against at least one antigen derived from a Zika virus, preferably in an animal. Said antibodies can be obtained and optionally be purified or modified, to provide composition suitable to treat a persisting Zika virus infection. For therapeutic approaches, further antiviral agents can be used to improve recovery of a patient suffering from a Zika virus infection. Antiviral agents are preferably an anti-Flaviviridae agents and include, but are not limited to, immunomodulatory agents, such as $\alpha$, $\beta$, and $\delta$ interferons, pegylated derivatized interferon-$\alpha$ compounds, and thymosin or other anti-viral agents, such as ribavirin, amantadine, and telbivudine; other inhibitors of viral proteases; inhibitors of other targets in the Flaviviridae (e.g. dengue virus, Hepatitis C virus) life cycle, including helicase, polymerase, and metalloprotease inhibitors; inhibitors of internal ribosome entry; broad-spectrum viral inhibitors, such as IMPDH inhibitors or combinations of any of the above.

In one embodiment, the immunogenic composition or the vaccine composition for use in a method of preventing or treating a Zika virus disease according to the present invention will not only protect a subject having been treated with said immunogenic composition or said vaccine composition, but it also has the capacity to prevent a Zika virus disease in an unborn fetus of a pregnant subject having been treated with said immunogenic composition or said vaccine composition to avoid the harsh and severe consequences of Zika virus infection during pregnancy and to protect the fetus by immunizing the mother of the unborn with the immunogenic compositions or vaccine compositions according to the present invention. This is of outstanding importance, as it has been demonstrated that Zika virus can pass from a pregnant infected woman to her fetus.

In accordance with the present disclosure, vaccines and/or immunogenic formulations of the present disclosure may be administered on a dosage schedule, for example, an initial administration of the vaccine composition with subsequent booster administrations. In particular embodiments, a second dose of the composition is administered anywhere from two weeks to one year, preferably from about 1, about 2, about 3, about 4, about 5 to about 6 months, after the initial administration. Additionally, a third dose may be administered after the second dose and from about three months to about two years, or even longer, preferably about 4, about 5, or about 6 months, or about 7 months to about one year after the initial administration. A third dose may be optionally administered when no or low levels of specific immunoglobulins are detected in the serum and/or urine or mucosal secretions of the subject after the second dose. In another embodiment, the compositions of the present disclosure can be administered as part of a combination therapy. For vaccine compositions according to the present invention based on a measles virus vector scaffold, a single administration or one administration followed by one booster injection will usually suffice to establish a protective immune response even in the presence of pre-existing anti-vector immunity against the measles virus scaffold. For active immunizations used for treating a Zika virus disease the dosage regimens can vary, but can be determined based on biomedical analyses before applying a composition for use in treating a Zika virus infection to a subject in need thereof.

The present invention is further described with reference to the following non-limiting to examples.

EXAMPLES

The present invention is further illustrated by the following non limiting examples.

Example 1: Zika Virus Antigen Design

The immunodominant antigen of Flaviviruses is protein E. Neutralizing antibodies that are triggered by a flaviviral infection are raised against this protein as highlighted in Pierson T C et al, 2008. Not much is known about the protein E of Zika Virus. But it is thought that it could exhibit the same features as that of other Flaviviruses like TBEV, WNV or Dengue. Therefore, the Zika Virus antigens underlying the present work were designed to comprise either the whole protein E, or a truncated, soluble form of protein E that lacks the stem-anchor region that is depicted in Stiasny et al, 2013. Research groups working on Flaviviruses have shown that soluble protein E can elicit neutralizing antibodies in diverse animal models. Zlatkovic et al, 2011 showed that for TBEV and WNV sE proteins in mice, Clements et al, 2010 for all four Dengue sE in mice and monkeys and Deprès et al, 2005 for WNV sE. In contrast to the sE protein of the group around Deprès that contained still some parts of the stem-anchor region, all other sE proteins had the whole stem-anchor region deleted. To evaluate whether these findings could also be verified for the Zika sE antigen, a variant that also lacks the whole stem-anchor region according to the sE proteins of Zlatkovic et al or Clements et al. was designed and further analyzed. Furthermore, an extensive analysis of all currently available Zika virus genomes was performed.

In addition to protein E, also the coding sequence of the whole protein prM was added to the Zika virus antigen in order to get an optimal protein expression. This was in agreement with the studies performed by Zlatkovic et al. and Clements et al. In contrast, Deprès et al generated measles virus constructs expressing only a WNV sE protein together with the C-terminal end of protein prM by which the E translocation sequence was encoded. According to the hypothesis that protein prM facilitates the proper folding of protein E, addition of the whole prM sequence would support an optimal expression of protein E in target cells and was therefore performed for the Zika sE design.

During an infection, Flaviviruses are also able to produce subviral particles that are smaller than virions and are composed of prM or M and E. Those particles are usually called recombinant subviral particles or RSPs. Allison et al. has already shown 1995 for TBEV that recombinant subviral particles can be formed by co-expressing prM and the whole E protein. Certain other research groups have also confirmed the formation of these recombinant subviral particles for other Flaviviruses and have used this unique feature of prM and E for vaccine development (Konishi et al, 2001 for JEV, Konishi and Fujii, 2002 for Dengue, Davis et al, 2001 for WNV and Wang et al, 2009 for Dengue). For designing the Zika RSP antigen, also the whole sequences of protein prM and E were used to obtain recombinant subviral particles of Zika. Moreover, a mutation (Leu107Asp) was introduced in protein E of Zika RSP at position 107. Allison et al, 2001 has shown that mutation of Leucin 107 to aspartic acid abolishes fusion of recombinant subviral particles of TBEV with the target membrane, but does not interfere with particle formation. Leu107 is furthermore located in a highly conserved motif that is common among all Flaviviruses and is therefore also likely to be present in the E protein of Zika virus derived sequences.

In addition, two basic residues Arg-Arg located in front of the prM signal sequence of Zika virus were added to the Zika sE and RSP antigen. In the context of the Flavivirus polyprotein, these amino acids form together with the following small non-branched amino acid the capsid cleavage site of the viral NS2B/3 protease at the C-terminal region of the capsid protein. Only upon cleavage at this site, capsid protein is released, the prM signal sequence moves towards the lumen of the ER, the signal sequence gets access to its cleavage site and the N-terminus of protein prM can be generated. Due to the fact that the designed Zika virus antigens do not encode the sequence for the whole capsid protein, no interference with the formation of protein prM is supposed, however it is believed that the addition of the basic residues supports the correct position of the prM signal sequence in the ER membrane and therefore also a better antigen expression, which is an important prerequisite for the development of immunogenic and active vaccine compositions.

Furthermore, a Kozak sequence (see e.g. SEQ ID NO:154 or 155) was also added in front of Zika virus sequence in order to obtain an optimal protein translation in target cells. After the start codon within the Kozak sequence, an additional gca insert encoding an alanin was introduced to obtain an optimal Kozak sequence for vertebrates with a "g" after the start codon. In order to avoid read-through during protein translation, more than one stop codon was added at the end of the Zika virus antigens. Two or three stop codons were added to obey the rule of six respectively. This rule of six is especially important, if Measles virus-derived RNA is used as a vector backbone, as otherwise no replication would be initiated. If working with other vector backbones, other design parameters have to be considered.

Example 2: Codon Optimization, Mutagenesis and Vector Construction

Certain Zika virus antigen candidates as detailed above were subjected to codon optimization as shown e.g. for inserts according to SEQ ID NOs: 53 and 54 (Zika virus sE+prM and Zika virus RSP+prM, respectively), before codon optimization in comparison to SEQ ID NOs: 55 and 56 (Zika virus sE+prM and Zika virus RSP+prM, respectively) after codon optimization for human codon usage. Codon optimization to adapt the codon usage of the desired nucleic acid sequences to a human codon usage was performed by Eurofins Genomic. Mutagenesis to analyze the function of position L107 in the various Zika virus serotypes analyzed was done by using a Quick Change II Site-Directed Mutagenesis kit (Agilent). Cloning of synthesized Zika virus inserts (synthesis: Eurofins Genomics) into a recombinant vector backbone was performed using standard techniques of molecular biology. Preferably, inserts were cloned into the vector backbone according to SEQ ID NO:60 or a comparable vector backbone derived from a measles virus Schwarz strain into the ATU2 region using the restriction enzymes BsiWI and BssHII.

Example 3: Infection and Master Cell Bank (MCB)

For the purpose of this example, a recombinant, Zika virus antigen expressing, live attenuated chimeric virus (see SEQ ID NOs: 57 comprising a MV Zika sE insert, human codon optimization and SEQ ID NO:58 comprising a MV Zika RSP insert, human codon optimization) was used which was generated by transfecting helper cells with the vector, wherein said helper cells are capable of expressing helper functions to express an RNA polymerase, and to express the N, P and L proteins of a MV virus; 2) co-cultivating said transfected helper cells of step 1) with passaged cells suitable for the passage of the MV attenuated strain from which the cDNA originates; 3) recovering the recombinant infectious virus expressing at least one structural protein of a Zika virus to provide a master virus seed stock (MVSS) (cf. the disclosure of WO 2014/049094 A1). Vero 10-87 cells served as host cells and as master cell bank (MCB). The MVSS used for this exemplary purification scheme can be obtained from the sequence according to SEQ ID Nos:57 and 58 according to the present application, or a suitable vector can be cloned by means of routine molecular biology based on the information provided herein, into a plasmid deposited under the Budapest Treaty at the Leibniz Institute DSMZ-German Collection of Microorganisms and Cell Cultures GmbH (DSMZ) (Inhoffenstraße 7B, 38124 Braunschweig, Germany) under the accession number DSM 32235 (pTM 2ATU MV CHIK) and DSM 32234 (pTM 2ATU MV DVAX1), respectively, for the purpose of EP15202480.8 this application claims priority of. Specific reference is thus made to this material as deposited by the same applicant for the purpose of the priority founding application EP15202480.8. The material was deposited as plasmid DNA. *Escherichia coli* was indicated as suitable host for transformation and propagation of the respective plasmids. Both, the deposit DSM 32235 and DSM 32234 were deposited on 15 Dec. 2015 and the viability was confirmed by DSMZ in a viability statement under Rule 10.2 of the Budapest Treaty on 16 Dec. 2015. DSM 32234 and DSM 32235 both comprise a NotI RE-Site (from the cloning vector), a T7 Promoter & T7 Terminator sequence, a 5': Hammerhead Ribozyme; 3': Hepatitis delta Ribozyme Sequence, a measles virus derived sequence, a measles promoter/terminator sequence, a Dengue (DSM 32234) or a Chikungunya (DSM 32235) insert cloned into the restriction sites BsiWI and BssHII; and a cloning vector sequence (plasmid is originally derived from pBluescript). An ampicillin resistance gene for selection is present. BsiWI and BssHII restriction sites can be used for cloning of appropriate Zika virus antigen encoding sequences of the present invention.

As detailed above for Example 2, the relevant Zika-antigens of interest as disclosed herein can be cloned into a vector backbone of interest suitable for vaccination purposes by using appropriate restriction endonuclease cloning, as detailed above, as detailed below for Example 16, or based on information as available from manufacturers/providers of suitable vector backbones.

Example 4: MCB Revival and Expansion Under GMP Conditions

Two cryovials each containing 1.0 mL MCB were removed from storage in vapour phase liquid nitrogen and are transported to the cleanroom in a sanitised container which is in turn transported on dry ice. Once within the cleanroom, the MCB cryovials were thawed in hands/at ambient while gently swirling the content until all ice within the vials has melted. When the vials had thawed they were transferred to a biosafety cabinet. The thawed cell suspensions from each vial were transferred aseptically into 50 mL centrifuge tubes. 9 mL of pre-warmed Dulbecco's Modified Eagle Medium (DMEM)+10% fetal bovine serum (FBS) medium were added drop-wise to each 50 mL tube containing the thawed cells while gently swirling the tubes. The MCB/WCB cryovials were each rinsed with the homogeneous cell suspension from the centrifuge tube and the rinse was transferred back to the respective 50 mL tubes.

The cell suspensions were then centrifuged at 300×g±5% for 5 minutes at room temperature. The supernatants were discarded and the pellets were suspended in 10 mL DMEM+10% FBS medium. The resuspended pellets were removed from the biosafety cabinet and centrifuged for a second time using the same parameters as before. The supernatant was again discarded and the pellets were resuspended in 10 mL DMEM+10% FBS medium. 0.5 mL from the prepared cell suspensions was removed and used to perform a cell count determining viable cells and viability. The remaining cell suspensions were passaged to one T225 cell culture flasks/suspension and medium was made up to 50 mL using pre-warmed DMEM+10% FBS medium. Following growth in flask culture, the supernatant from the 2×T225 flasks was removed, discarded and the cell monolayer was washed with pre-warmed D-PBS. Pre-warmed TrypLE Select was added to each flask and distributed evenly over the monolayer. Flasks were incubated to detach cells and then observed for cell detachment under the microscope. If necessary, the flasks were taped gently for cell detachment. If detachment was below 90%, flasks were further incubated until detachment of greater than 90% was reached.

Pre-warmed DMEM+10% FBS medium was added to each flask and the cell suspension was removed to sterile centrifuge tubes. After centrifugation, the supernatant was removed and discarded while the cell pellets were resuspended in DMEM+10% FBS medium by pipetting up and down. The cultures were fully suspended if no cell clumps were visible. Resuspended cell-solutions from 2×T225 flasks were each transferred into sterile containers (50 mL centrifugation tube) and mixed to obtain a homogenous solution of cells. 0.5 mL from the prepared cell suspensions were removed and used to perform a cell count determining viable cells and viability of each cell solution. The remaining cell suspensions were passaged to 5×T225 cell culture flasks/suspension and medium was made up to 50 mL using pre-warmed DMEM+10% FBS medium. Thus, in total 10×T225 flasks were prepared in this exemplary setting, which might naturally depend of the nature of the product to be produced.

Following growth in flask culture stage 2, the supernatant from the two T225 sets flasks was removed, discarded and the cell monolayer was washed with pre-warmed D-PBS. Pre-warmed TrypLE Select was then added to each flask and distributed evenly over the monolayer. Flasks were incubated to detach cells and then observed for cell detachment under the microscope. If necessary, the flasks were taped gently for cell detachment. If detachment was below 90%, flasks were further incubated until detachment of greater than 90% was reached. Parameters are described in Table 1 below.

Pre-warmed DMEM+10% FBS medium was added to each flask and the cell suspensions were removed to sterile centrifuge tubes. The cell suspensions were then centrifuged as described in Table 3 below. After centrifugation, the supernatant was removed and discarded while the cell pellets were resuspended in DMEM+10% FBS medium by pipetting up and down. The cultures were fully suspended if no cell clumps were visible. Resuspended cell-solutions from each set (5×T225 flasks) were transferred/pooled into one sterile container (50 mL centrifugation tube) and mixed to obtain a homogenous solution of cells. 0.5 mL from the prepared cell suspensions were removed and used to perform a cell count determining viable cells and viability of each cell solution. After analysis of viable cells and viability, the best performing set of T225 flasks was selected and passaged to 30×T225 cell culture flasks and medium was made up to 50 mL using pre-warmed DMEM+10% FBS medium.

TABLE 1

Flask culture parameters: stage 3

| Stage | Parameter | Operating criteria (range) |
|---|---|---|
| Cell culture Stage 3 | Seeding density | $2.00 \times 10^4$ cells/cm$^2$ |
| | Culture volume (T225) | 50 mL |
| | Culture media | DMEM + 10% FBS |
| | Incubation Temperature | 36.5 ± 1° C. |
| | Duration | Approximately 4 ± 1 days |
| | CO$_2$ | 5.0% ± 2% |
| | Humidity | 80% ± 10% |
| | Final cell density | ≥80% confluent cells |
| | Final cell viability | ≥80% viability |
| Cell harvest | PBS Cell wash volume (T225) | 10 mL |
| | TrypLE select volume (T225) | 5 mL |
| | Cell detachment incubation temperature | ambient |
| | Cell detachment incubation time | 5 min then until 90% detachment |
| | DMEM + 10% FBS added for centrifugation | 10 mL |
| | Centrifugation (g) | 300 × g ± 5% |
| | Centrifugation time | 5 minutes |
| | Centrifugation temperature | Room temperature |
| | Pellet resuspension media (DMEM + 10% FBS) volume | 10 mL |

Following growth in flask culture (stage 3), the supernatant from the 30×T225 flasks was removed, discarded and the cell monolayer was washed with pre-warmed D-PBS. Pre-warmed TrypLE Select was added to each flask and distributed evenly over the monolayer. Flasks were incubated to detach cells and observed for cell detachment under the microscope. If necessary, the flasks were taped gently for cell detachment. If detachment was below 90%, flasks were further incubated until detachment of greater than 90% was reached.

Pre-warmed DMEM+10% FBS medium was added to each flask and the cell suspension was removed to sterile centrifuge tubes. The cell suspension was then centrifuged. After centrifugation, the supernatant was removed and discarded while the cell pellet was resuspended in DMEM+10% FBS medium by pipetting up and down. The culture was fully suspended if no cell clumps were visible. Resuspended cell-solutions from all 30×T225 flasks were transferred into one sterile container and mixed to obtain a homogenous solution of cells. 0.5 mL from the prepared cell suspension were removed and used to perform a cell count determining viable cells and viability.

Example 5: Spinner Flasks and Bioreactor Microcarrier Assisted Culture (Stage 4)

Per 1 L spinner flask, 10 g HillexII microcarrier were resuspended in 200 mL water-for-injection (WFI) and autoclaved under saturated steam for 20 minutes at 2 bar and 121° C. Any suitable microcarrier suitable as carrier material of a host cell of interest can be chosen for the purpose if the microcarrier assisted culture. Post sterilization, microcarrier were allowed to sediment, the WFI was removed carefully, discarded and microcarrier were washed with 200 mL PBS. Finally, PBS was replaced by 100 mL pre-warmed DEMEM+10% FCS medium without phenol red. Medium with phenol red can also be used for this step. The sterilized microcarrier was then transferred into the respective 1 L spinner flask by pipetting the medium/microcarrier suspension carefully.

The required amount of cells was transferred aseptically into each spinner flask. The medium was made up to 500 mL using DMEM+10% FBS medium without phenol red. In total, 6 spinner flasks were prepared and transferred into the incubator, containing magnetic stirrer plates; agitation is set to 35 rpm. Seeded spinner flasks were incubated over night and medium was made up to 1 L using DMEM+10% FBS medium without phenol red the next day. Spinner flasks were then removed from the incubator and transferred into a biosafety cabinet. Spinner flasks were allowed to stand for 5 minutes without agitation to enable cell-containing microcarrier to sediment. Supernatant from each spinner flask was removed carefully, discarded and the microcarriers were washed with pre-warmed D-PBS. The cell/microcarrier suspensions from each spinner flasks were then transferred into a sterile container (500 mL) and washed twice with D-PBS. Pre-warmed TrypLE Select was added to the container and mixed gently to obtain a homogenous solution. Microcarriers were incubated to detach cells and cell detachment was controlled under the microscope. When a cell detachment of greater than 90% was reached, pre-warmed DMEM+10% FBS medium without phenol red was added and a viable cell count as well determination of viability was performed.

Per 10 L bioreactor, 100 g HillexII microcarrier were resuspended in 2000 mL WFI and autoclaved under saturated steam for 20 minutes at 2 bar and 121° C. Post sterilization, microcarrier were allowed to sediment, the WFI was removed carefully, discarded and microcarriers were washed with 2000 mL PBS. The sterilized microcarriers were then transferred into the respective 10 L bioreactor by pumping the PBS/microcarrier suspension carefully using a peristaltic pump. Alternatively, microcarrier preparation can be performed together with the sterilization process of the bioreactor glass vessel: Fill the bioreactor with 100 g HillexII and add 20 ml WFI/g HillexII. Wash 1× with 20 ml fresh WFI/g HillexII and 1× with 20 mL PBS/g HillexII. When the bioreactor is completely assembled a pressure test will be performed to check if the bioreactor is closed. Then autoclave for 20 minutes at >121° C. When the bioreactor was sterilized and connected to the control unit, all probes (dissolved oxygen (DO), temperature and pH) the heating jacket, stirrer and an extra sample pipe to extract medium above settled microcarriers from the bioreactor were connected. When settings were stabilized for approximately 6 hours airflow over sparger with 75 RPM agitation and a temperature set point of 37° C. was started. When probe signals were stable a 100% DO calibration was performed. After the DO calibration airflow, heating and agitation was stopped and microcarriers were allowed to settle to the bottom of the bioreactor. Supernatant above settled carriers was removed using the extra sample pipe installed. The bioreactor was filled with 2.2 liter medium without phenol red (2 Liter medium+10% FBS). Finally, agitation at 75 RPM, airflow overlay 0.25 L/min, heating at 36.5° C. was started. A sample was taken to recalibrate the pH by the offline measurement. The bioreactor was then ready for inoculation with cells.

The required amount of cells (as a suspension with the detached microcarrier from the previous step) was transferred aseptically into the reactor containing 100 g microcarrier and 2.2 L pre-warmed DMEM+10% FBS medium without phenol red. In general, the full content of two 1 L spinner flasks was transferred to one 10 L bioreactor. This represents a seeding density of 4 to $5 \times 10^4$ cells/cm$^2$ and a split ratio of 1:5. These parameters naturally can vary depending on the host cell and the MVSS chosen for each setting. After cell transfer, medium was filled up to 10 L working volume and pH control ($CO_2$ and sodium bicarbonate) as well as DO control ($O_2$ sparging) were started. Samples were regularly taken for microscopic observation and cell counts.

Example 6: Cell Culture Infection

Approximately 5 mL of the cell/microcarrier suspension within the bioreactor were removed to determine confluency of the microcarrier and a viable cell count was performed. Cells should be ≥80% viable and microcarrier ≥80% confluent. The cell count was used to determine the number of viral particles required to infect the culture at an MOI of 0.01 $TCID_{50}$/cell. This MOI may again vary depending on the host cell and the MVSS chosen, but can be easily determined after standard pre-testings with the respective host cell and the respective virus. MOIs between 0.0001 and 0.1 are preferable. Notably, the time point for harvest will change depending on the chosen MOI, which can be determined by the skilled person. After calculating the required amount of virus, an appropriate number of viral vials were removed from −80° C. storage and they were transported to the cleanroom. The virus vials were thawed at ambient/in hands until all ice has melted. The virus volume required to infect the 10 L suspension at an MOI of 0.01 $TCID_{50}$/cell was calculated and is diluted in 5000 mL VP-SFM w/o phenol red.

Agitation of the bioreactor, DO and pH control were stopped and the microcarrier/cells suspension within the bioreactor was allowed to stand for 10 minutes without agitation to enable cell-containing microcarrier to sediment. The spent medium was removed carefully, discarded and the microcarrier were washed twice with 2500 mL pre-warmed D-PBS. 3000 mL VP-SFM w/o phenol red was added, incubated for 5 minutes at 36.5±1° C./50 rpm, removed carefully and discarded. The previous prepared viral suspension was then added to the bioreactor and allowed to incubate for 4 to 6 hrs at 32.0° C.±4° C., preferably at 32° C.±1° C., pH at 7.2±0.2, DO>40% and 75 rpm. After a viral adsorption period of 4-6 hrs, medium was filled up to 10 L using VP-SFM w/o phenol red.

The infected microcarrier/cell suspension was observed daily from the 4$^{th}$ day of viral prorogation until ≥80% CPE was observed.

Testing was performed upon viral infection as described in Table 2 below.

TABLE 2

Testing during viral propagation

| Sample Stage | Testing | Acceptance criteria |
| --- | --- | --- |
| Viral Propagation | Macroscopic and microscopic observation | Adherent cuboidal cells |
| | Media Colour | Red/orange media |
| | Evidence of contamination | No evidence of contamination |

Example 7: Benzonase Treatment

Additionally, the protocols disclosed herein can comprise a DNAse treatment step. This treatment can be performed before or after clarifying the virus suspension depending on the host cell and the recombinant infectious virus particle to be purified. A preferred to DNAse is a benzonase, but any suitable DNAse having comparable activity, specificity and purity can be chosen for this purpose, whereas the choice of a suitable DNAse can easily be made by a person skilled in the art.

Next, agitation, DO, pH control was stopped and the microcarrier/cells suspension within the bioreactor was allowed to stand for 10 minutes without agitation to enable cell-containing microcarrier to sediment. Virus-containing supernatant was transferred carefully from the bioreactor to one sterile 50 L flexboy bag using the aseptic transfer line by pressure and/or gravity.

The required amount of benzonase and magensium chloride (the cofactor, concentration and required solution may vary depending on the DNAase chosen for the assay) to obtain final concentrations of 50 u/mL and 2 mM was calculated. Benzonase was removed from −20° C. storage, transported to the cleanroom on dry ice and thawed at ambient. Within the biosafety cabinet a stock solution of 200 mM magnesium chloride solution was prepared from 1 M magensium chloride using WFI as diluent. Prior to addition, the calculated volumes of magnesium chloride and Benzonase were mixed together into a homogeneous solution and then added to the viral suspension and swirled gently. Magnesium chloride and Benzonase were added to such that the final concentration of the Benzonase within the solution was 50 u/mL and the final concentration of magnesium chloride is 2 mM. The 50 L bag was placed on an orbital shaker within an incubator and incubated at 37±1° C. for one hour under gentle agitation. The parameters may vary depending on the DNAse used, but can easily be adapted by the person skilled in the art in the knowledge of the present disclosure. The four 3 L spinner flasks containing the benzonase treated virus suspension were transferred to the downstream part directly (processing on one day) or stored at 4° C. over night (processing on two days). It should be avoided to store the benzonase treated pool longer than over night.

Example 8: Unpurified Bulk Specification

Following harvest/benzonase treatment, the material was tested. In accordance with the unpurified bulk specification as shown in Table 3 below. Kits and methods to perform said testing are readily available to the skilled person.

TABLE 3

| | Unpurified Bulk Specification | |
|---|---|---|
| Purity | Mycoplasma EP 2.6.7 | Negative |
| | In-vitro adventitious agents | Negative |
| | In-vivo adventitious agents | Negative |

Example 9: Downstream Manufacture—Clarification

For clarification of the optionally benzonase treated virus suspension, Sartorius Sartopore PP3 depth filtration units were used. Two filters are connected in parallel to allow a switch between filters in case of pressure increase. First, both filters were flushed with sterile PBS and a pressure hold test was performed at 20 psi for 5 minutes. The benzonase treated harvest was connected to the inlet tubing of the clarification filters whereas inlet of filter 1 was open and inlet and outlet of filter 2 were closed. Benzonase treated material was clarified by filtration through filter 1 using a maximum pressure of 20 psi. Pump speed may be adjusted to maintain pressure below 20 psi if required. In case pressure reaches 20 psi before the complete harvest is filtered switch to bypass filter (filter 2). Once the complete harvest was filtered, filter 1 (and 2) were emptied by pumping air to the filter trains. The clarified virus material was directly subjected to purification.

The clarification method chosen here can vary depending on material to be clarified and any suitable filtration method can be applied. It is important to consider the polymorphic large surface of the measles virus, which represents the scaffold structure to be clarified. Therefore, suitable filter materials have to be chosen, which do not show unspecific binding of the measles virus scaffold based preparation, which would result in a loss of yield or functionality. As detailed above, centrifugation should be avoided due to the limited scalability thereof under GMP conditions and/or the risk of contaminations.

Example 10: Column Chromatography Based Purification

CIM®-OH Column Preparation

1×80 mL CIM®-OH monolithic column (Bia Separations) with a pore size of 6 μm was removed from storage at 2-8° C. and was allowed to warm up for 2 hours prior to use. Any other suitable column can be used for purification provided that it allows specific retention of the measles virus scaffold based virus suspension comprising recombinant infectious virus particles in the respective dimensions and with the respective chemical properties of its surface structure. Preferably, a pore size of at least 4 μm, preferably more, should be chosen to avoid clogging of the column and unspecific binding due to the dimensions of the measles virus derived virus preparation to be purified. Any column based on hydrophobic interaction, affinity, size exclusion or ion exchange as separating principle can be used depending on the nature of the insert, which can, for example, comprise an affinity tag in a protein coding region or which can have specific characteristics to apply an ion exchange chromatography. An exemplary procedure using an ÄKTA Pilot chromatography system is set up as described below. Any suitable chromatography system can be chosen for the purpose of the present invention provided that it is compatible with the column chosen.

The pH electrode was calibrated according to respective standard operating procedures. Inlet tubings were connected to the ÄKTA Pilot system inlets A1, A2, B1, B2, B3 and sample inlets S1 and S2 and were tie wrapped. Using a sterile connective device (SCD), a two T-piece was connected to the inlet tubing on S1 to create a bypass on this line. Using the SCD, cleaning tubing was connected to the inlet tubing on A1, A2, B1, B2, B3, S2 and both lines of the T-piece on S1. Outlet tubing was connected to the ÄKTA Pilot system outlets F1, F3, F5 and F7 using and each connection was tie wrapped. Airvents were clamped off on the outlet tubing with Kocher clamps. Using the SCD a cleaning outlet tubing set was connected up to outlet tubing on F1, F3, F5 and F7 and to one 20 L waste bag. The CIM®-OH monolith column was connected in upflow direction to column position 2. The second column was placed to column position 3. Using the SCD, the 1.0 M NaOH solution (>6.5 L/column) was connected to the inlet cleaning tubing. All inlets, outlets and the system were flushed with 1.0 M NaOH. The monolith columns were conditioned with a minimum NaOH contact time of 120 minutes. Using the SCD the 1.0 M NaOH connected to the inlet cleaning tubing was replaced with 0.1 M NaOH (>4 L/column). All inlets, outlets and the system were flushed with 0.1 M NaOH (at this stage the columns can be stored connected to the system). Using the SCD the 0.1 M NaOH connected to the inlet cleaning tubing was replaced with WFI (>6.5 L/column). All inlets, outlets and the system were flushed with WFI. Using the SCD the equilibration buffer (>7 L/column) was connected to A1, S1 and S2, the elution buffer (>3 L/column) to A2 and WFI (>4.5 L/column) to B2. 1.0 M NaOH was connected to B1. Using the cleaning tubing, equilibration buffer was connected to A1, S1 and S2. All inlets, outlets and the system were flushed with the respective buffers. When flush was complete, the outlet tubings are emptied by opening the attached air vent. Using the SCD the waste bag on F1 was replaced with a new waste bag. Using the SCD two sterile 20 L bags were connected to F3 to collected the flow through for each column. Bag 2 was clamped off. Using the SCD two sterile 5 L bags were connected to F5 to collected the wash fractions from each column. Using the SCD a sterile 1 L bag was connected to F7 to collected the elution fraction (elution from column 1 and 2 are pooled within one bag)

Sample Preparation

The benzonase treated material was connected to a sterile 50 L bag/bottle placed on an orbital shaker/stirring plate using the SCD. A peristaltic pump head was placed between virus suspension and the empty vessel. The unpurified bulk was pumped completely into the empty vessel. Using the SCD, the sample preparation buffer (>10 L) was connected to the 20 L vessel. A peristaltic pump head was placed between the buffer and the vessel already containing the 10 L virus suspension. An equal volume of sample preparation buffer has to be added to the virus pool to bring the Ammonium Sulphate concentration to 1.8 M. Pumping of buffer and stirring of the solution has to be performed in a very gentle way so that a vortex is seen but no foaming is observed.

Virus and VLP/RSP Purification

The diluted virus solution was connected to one of the bypass lines of inlet S1, using the SCD. The bypass on S1 is used to remove air from the line. It has to be ensured that no air will be introduced into inlet S1 later on. Otherwise only part of the virus material will be processed on the respective column. Purification was performed as outlined in Table 18. The virus peak is collected in F7 with UV monitoring (start >50 mAU, stop after 4 column volumes). Depending on the resolution and the parameters chosen for column purification and depending on the column material, either one product peak will be obtained comprising the recombinant chimeric virus particles derived from a measles virus scaffold including nucleic acid material from a Zika virus packaged therein and optionally (if present) virus-like particles or recombinant subviral particles in one peak. Alternatively, two separate peaks can be obtained, one comprising the recombinant infectious virus particles and the other one comprising VLPs/RSPs devoid of nucleic acid material. In the case of co-elution, as exemplified in this example, the mixed population comprising both the recombinant infectious virus particles comprising Zika virus antigens and the virus-like particles can optionally further be purified, polished or subjected to a buffer-exchange as detailed above. For the co-elution, the following parameters were chosen: Maximum pressure 5.0 bar. After completion of the run, all outlets were emptied by opening the air vent on the outlet. The outlet air vents and bags were clamped off and the bags were then disconnected from the outlets using the SCD. Product collection during elution was determined by $UV_{280}$ reading on the UV detector. The main peak collection was started when the $UV_{280}$ is >50 mAU and was stopped when a minimum of 4 CV's of Elution buffer had passed through the column. Peak collection parameters are tabulated in Table 19 below. At the end of the purification cycle, the exact volume of main peak fraction was noted and the bulk virus pool was snap frozen at −80° C.±10° C. directly or aliquot as required prior freezing. Alternatively, part of the virus pool can immediately be subjected to further analysis, including analysis for purity and infectivity and the like. The main peak fraction can additionally be subjected to a further round of purification, polishing or buffer-exchange to separate recombinant infectious virus particles containing genetic material from optionally present virus-like particles. Using the SCD, 20% EtOH was connected to buffer inlet B3. The system was flushed with 20% EtOH. Using the SCD, all buffers from the Äkta Pilot inlets were disconnected and discarded, the T-piece on inlet S1 was disconnected and discarded and a cleaning tubing was connected to inlets 51, S2, A1, A2, B1, B2 and B3. The cleaning inlet tubing was connected to 1 M NaOH. All inlets, outlets and the system were cleaned with 1 M NaOH. The 1 M NaOH connected to the cleaning tubing was replaced by WFI. Flush the system with WFI. Replace the WFI connected to the cleaning tubing by 20% EtOH. Store the Äkta Pilot in 20% EtOH.

Example 11: Testing

Following the purification, the material was tested in accordance with the specification in Table 4 below.

TABLE 4

Testing Specification

| Test Category | Test Method | Acceptance Criteria |
|---|---|---|
| Potency | Titration of measles virus by TCID50 (Infectivity) | $\geq 10^4$ $TCID_{50}$/mL |
| Identity | Determination of identity of MV-sE or RSP vaccine by PCR | Amplification product of 321 bp observed for PCR1<br>Amplification product of 621 bp observed for PCR2 |
| Physico-chemical | Potentiometric determination of pH | 7.5 ± 0.5 |
|  | Particulate contamination: visible particles | Clear to opaque colourless liquid (There may be product related particles visible) |
| Purity | Sterility | No growth |
|  | Enzyme Immunoassay (EIA) for the detection and quantification of residual Benzonase in a test sample | below 100 ng/mL |
|  | Detection and quantification of residual Vero DNA in biological samples | below 10 ng/dose |
|  | Vero Host Cell Protein (HCP) ELISA | below 5 µg/mL |
|  | Detection of Bovine Serum Albumin (BSA) by ELISA | below 500 ng/mL |

Process related impurities were determined using the following kits and assays: (i) for detection and quantification of residual Vero host cell DNA: Cygnus ELISA Kit; (ii) detection and quantification of residual Vero DNA in biological samples: Life Technologies qPCR assay; (iii) for detection of Bovine Serum Albumin: Cygnus ELISA Kit; and (iv) for detection of residual Benzonase: Merck ELISA Kit.

Example 12: Characterization of MV Vaccine Candidates In Vitro

MV Zika sE (see SEQ ID NO:57) and RSP viruses (see SEQ ID NO:58) were rescued as detailed above and their biological properties were determined in cell culture. First, growth properties of MV Zika sE and RSP were analyzed and compared to the parent MV Schwarz. The sequences according to SEQ ID NO:59, and preferably according to any one of SEQ ID NOs: 60 or 192. Growth curve analyses were performed on Vero 10-87 cells. To this end, the cells were infected with a defined MOI (MOI of 1, 0.1 or 0.01) and samples were taken at different time points. Both viruses, MV Zika sE and MV Zika RSP, exhibited similar growth kinetics than the MV Schwarz parent strain as determined by TCID50 and/or qPCR. In addition, the antigen expression of the Zika sE and E proteins, respectively, were determined by indirect immunofluorescence staining and by Western Blot analysis. Vero 10-87 cells were thus infected with a defined MOI (1, 0.1 or 0.01). Depending on the MOI used, cells exhibited a bright staining for Zika sE and E proteins indicating that Zika sE and/or E proteins can be expressed from the measles virus vector backbone. Furthermore, Zika sE and/or Zika E proteins were detected in MV Zika sE and Zika RSP infected cell lysate samples and in supernatants collected from these infected cells, respectively, by Western blot analysis. In addition, Zika sE or Zika E proteins were also detected in supernatants of MV Zika sE and RSP infected cells by enzyme-linked immunosorbent assay (ELISA) using specific antibodies. Suitable antibodies, e.g. currently used for diagnostic purposes, are available to the skilled person.

Furthermore, different Zika virus specific hybridomas (e.g. ZIKV-2, ZIKV-13, ZIKV-16 and ZIKV-23), upon request, are available from Washington University. The integrity of the Zika virus sE and RSP inserts present in the virus genome was confirmed by double-stranded sanger sequencing. In addition to that, the MV Zika sE and RSP virus was passaged further (up to passage 8) to check the genomic stability of the Zika virus insert. As determined by sanger sequencing, no changes in the Zika insert sequences was found, showing stability of said inserts and thus suitability of the relevant constructs.

Example 13: Immunization Experiments

To evaluate the immunogenicity of the purified material, i.e. the immunogenic composition comprising at least one Zika virus antigen as obtained from SEQ ID NOs:57 and 58 (MV-Zika sE and RSP, respectively) (purified or non-purified) were further tested by the following animal studies:

To evaluate the immunogenicity of our MV Zika vaccine candidates in an animal model, groups of cotton rats were vaccinated intramuscularly with various doses of MV Zika sE (as comprised by SEQ ID NO:57) and MV Zika RSP (as comprised by SEQ ID NO:58), respectively. In all cases, a single immunization was sufficient to induce Zika sE or Zika E specific antibodies in the serum when measured four weeks after the first vaccination for both the purified and the non-purified virus material. All cotton rats were given a homologous booster immunization four weeks after the first, and this resulted in an increase in Zika sE or Zika E specific antibodies when measured three weeks later. To analyze antibodies, ELISA or plaque-reduction neutralization tests (PRNT) or comparable methods can be performed to measure virus-specific neutralizing antibodies. Zika specific and cross-reactive antibodies are presently available. Suitable antibodies, e.g. currently used for diagnostic purposes, are available to the skilled person. Furthermore, different Zika virus specific hybridomas (e.g. ZIKV-2, ZIKV-13, ZIKV-16 and ZIKV-23), upon request, are available from Washington University.

To evaluate the T-cell response elicited by the MV-ZIKA vaccine candidates, female 6-8 week old cotton rats were immunized twice with 1×10e5 $TCID_{50}$ MV Zika sE and RSP, respectively. MV-Schwarz without ATU (SEQ ID NO:59) or with ATU (see e.g. SEQ ID NOs:60 or 192) was used as a negative control. One week after the second immunization, the cotton rats were sacrificed and splenocytes were harvested. The cells were stimulated in vitro with pathogen specific peptides and the number of interferon gamma (IFNγ) producing T cells were determined by ELISPOT. Compared to the control MV-Schwarz (here SEQ ID NOs: 60 or 192), the MV Zika vaccine candidates induced the production of ZIKV-specific T-cells indicating that the Zika antigens are able to induce a cellular immune response directed against the target indication and, therefore, represent suitable vaccine candidates showing a protective humoral as well as a protective cellular immune response in an animal model.

Example 14: Safety and Toxicity Studies

To evaluate the safety and potential toxicity of the immunogenic MV Zika vaccine (for MV Zika sE, see SEQ ID NO:57; or for MV Zika RSP, see SEQ ID NO:58), a single as well as a repeated dose-toxicity study was performed in cynomolgus macaques under good laboratory practice (GLP) conditions. Group 2, composed of three male and three female purpose-bred cynomolgus macaques was treated on day 1, and Group 3, also composed of three males and three females, on days 1, 22 and 36 by intramuscular route of the test immunogenic Zika vaccine composition. The animals were sero-negative to measles and Zika virus. A further control group, Group 1, comprising three males and three females, received vehicle only (sterile saline) on days 1, 22 and 36. Treatment was performed at a dose ranging from $1\times10^6$ to $1\times10^7$ $TCID_{50}$/day of injection. One dose, for example, could be about $5\times10^6$ $TCID_{50}$/day. This dose can naturally vary depending on the specific batch tested and depending on the material available and can be even lower (at least one log) or higher, as evaluated from the pre-testing.

After pre-experimentation, the dose of $9.45\times10^6$ of MV Zika sE was used for further experiments. This dose represents the maximum human dosage intended for use in clinical trials. Blood samples were taken for the determination of serum levels of antibodies against the vaccine antigen, for measles serology and for haematology and biochemistry at various time points. For determining the immunogenicity, blood samples are taken in pretest and on day 11 post vaccination of Group 2 having received only one immunization, and in pretest, on day 11, 22, 36, 50 and 64 of Group 3 that received three vaccinations. Blood samples for measles serology were taken once in pretest, on day 11 of Group 2 and on day 22 of the other groups. Blood samples for hematology and blood biochemistry were taken for all animals in pretest and on the day of necropsy. No unscheduled deaths occurred during the study. There were no test item-related clinical signs during the treatment and treatment-free periods. MV-ZIKA was well tolerated locally and no signs of systemic toxicity were noted throughout the study. Seroconversion to measles virus was observed in all animals that received the test material MV-Zika comprising material according to SEQ ID NO:57 (D11 Group 2 and D22 Group 3). Seroconversion to Zika was observed in 5/6 animals of Group 3 as determined at D22 after the first immunisation. In addition, neutralizing antibodies were found in 4/6 animals of this group after the second vaccination as determined by microneutralisation test.

Said data demonstrate that the immunogenic compositions indeed provide a protective immune response in a mammal in vivo and thus represent promising vaccine candidates for immunisation to achieve a broad protection against Zika virus based on a protective humoral and additionally a protective cellular immune response induced by the above vaccine candidates in a macaque animal model. Furthermore, suitable antibodies can be obtained when using the nucleic acid molecules and immunogenic Zika compositions, which in turn can be used to provide therapeutic antibodies, which can be used to treat a Zika virus infection.

Example 15: Further Immunization Experiments

To evaluate the immunogenicity of the purified material, i.e. the immunogenic compositions and nucleic acid molecules according to the present invention if cloned into a measles virus scaffold (MV-Zika p), in comparison to the crude, unpurified material (MV-Zika up) the following further animal studies can be conducted:

1. Humoral response after two immunizations
2. T cell response after two immunizations The animal model of choice for this set up would be a transgenic mouse carrying the human MV entry receptor CD46 (see above). In addition these mice are deficient in the type 1 interferon receptor ($CD46^{tg}$/$IFNAR^{-/-}$). In previous studies the immunogenicity of various MV/Schwarz based construct was demonstrated (MV-CHIK, MV-DENV, etc.). Also female cotton rats could be used for this purpose as detailed above. A result of this type of study would be:

Formulation A (purified, MV-Zika p, e.g. based on SEQ ID NOs: 57 (sE) or 58 (RSP)) induces these humoral and cellular responses in 6 mice or cotton rats; Formulation B (unpurified, MV-Zika up) induces this immune response. For the study of the humoral immune response we propose the following study set up:

5-6 week old $CD46^{tg}$/$IFNAR^{-/-}$ mice or 6-8 week old cotton rats will receive two immunizations. Antibody levels after prime and boost immunization as determined by ELISA and/or NT can be quantified and compared.

TABLE 5

| Group | No of Mice/ cotton rats | Treatment | Dose (MV-X) | Vaccination Schedule |
|---|---|---|---|---|
| 1 | 6 | MV-Zika p Formulation A | $1 \times 10^3$ or more | Day 0, 28 |
| 2 | 6 | MV-Zika up Formulation B | $1 \times 10^3$ or more | Day 0, 28 |
| 4 | 6 | MV-Schw (e.g. based on SEQ ID NOs: 59, 60 or 192) | — | Day 0, 28 |

Preferable doses could be: $1 \times 10^3$ to $1 \times 10^6$.

T Cell Study—IFNγ Producing Cells after Two Immunizations

Mice will be immunized with a low dose of MV-Zika (Formulation A (purified) or B (unpurified)) or a control MV/Schwarz. One week after the second immunization the mice will be sacrificed and splenocytes will be harvested. The cells will be challenged in vitro with pathogen specific peptides and the number of interferon gamma (IFNγ) producing T cells will be determined by ELISPOT. Immunogenicity, safety and advantages of the purification schemes as disclosed herein can thus simultaneously tested within this mouse model.

Mice will be immunized with a low dose of MV-Zika sE or RSP (Formulation A (purified) or B (unpurified)) as detailed above, or with a control MV/Schwarz. 5-6 week old female $CD46^{tg}$/$IFNAR^{-/-}$ mice will receive two immunizations as detailed above (preferable doses: $1 \times 10^3$ to $1 \times 10^6$). During immunization or subsequently thereto, the female mice will be mated. The pregnant immunized mice will then be challenged with Zika virus. It will be evaluated whether protection of the female mice treated in advance with the Zika vaccine candidates will also protect the fetuses of said mice from Zika virus infection.

Example 16: Expression of Zika sE and RSP Antigens by Using Lentiviral Vectors

For construction of lentiviral transfer vectors encoding the Zika sE and RSP antigens, the sequences of Zika sE and Zika RSP according to SEQ ID NOs: 55 and 56 were amplified by PCR with primers encompassing NheI/NotI restriction sites and pCDNA3.1-sE and pCDNA3.1-RSP as template, respectively. PCR reactions that yielded one distinct band with the corresponded size as visualized by gel electrophoresis were further purified and inserted into pCR2.1-TOPO (Invitrogen Life Technologies) by using the TOPO® TA Cloning® Kit. For transformation and amplification, competent DH5alpha *E. coli* cells were used. Plasmids containing intact Zika sE and RSP antigens were determined by sanger sequencing and the desired Zika antigen sequence was further cloned into lentivector pCDH-CMV-MSC (SBI) via NheI/NotI by using NheI/NotI restriction sites to generate the plasmids pCDH-CMV-sE and pCDH-CMV-RSP, respectively.

Lentiviral vectors were produced using 293T cells and PureFection Transfection Reagent (SBI). 293T cells were seeded in 175 $cm^2$ cell culture flasks. After an overnight incubation, these cells were transfected using a standard three-plasmid lentivirus vector system in order to produce lentivirus vectors pseudotyped with the G protein of vesicular stomatitis virus (VSV-G). The lentivector constructs pCDH-CMV-sE and pCDH-CMV-RSP, respectively, were transfected into these 293T cells together with packaging plasmids expressing the HIV proteins required for packaging and particle formation and a plasmid expressing VSV-G. The medium was exchanged 1 day posttransfection and pseudovirus particles HIV-pCDH-CMV-sE and HIV-pCDH-CMV-RSP (VSV-G) were harvested 2-3 days posttransfection, respectively. For harvest of particles, supernatants were cleared from cell debris by centrifugation at 3.000× g for 15 min. at room temperature. Then, pseudoviral particles were further concentrated by centrifugation at 100,000×g for 3 hours at 4° C. The pellets were resuspended in DMEM containing 25 mM HEPES buffer and stored below −65° C. Then, target cells (i.e. Vero 10-87 cells) were transduced with a defined MOI of HIV-pCDH-CMV-sE and HIV-pCDH-CMV-RSP (VSV-G) particles and the expression of the Zika antigens sE and RSP was determined by indirect immunofluorescence staining and Western Blot analysis using ZIKV-specific antibodies. Therefore, Zika sE and RSP derived immunogenic compositions can also be obtained independent of the vector backbone chosen to yield immunogenic compositions suitable for vaccination purposes.

SEQUENCE LISTING (192 sequences)

SEQ ID NO: 1 - DNA, 10662 bp, Zika virus
  Strain BeH818995 polyprotein gene
gtgaatcagactgcgacagttcgagtttgaagcgaaagctagcaacagtatcaacaggttttattttggatttggaaacgagagtttctggtcatgaaaaacccaaaaaagaaatccggaggattccggattgtcaatatgctaaaacgcggagtagcccgtgtgagcccctttgggggcttgaagaggctgccagccggacttctgctgggtcatgggcccatcaggatggtcttggcgattctagcctttttgagattcacggcaatcaagccatcactgggtctcatcaatagatggggttcagtggggaaaaaagaggctatggaaataataaagaagttcaagaaagatctggctgccatgctgagaataatcaatgctaggaaggagaagaagagacgaggcgcagatactagtgtcggaattgttggcctcctgctgaccacagctatggcagcggaggtcactagacgtgggagtgcatactatatgtacttggacagaaacgatgctggggaggccatatcttttccaaccacattggggatgaataagtgttatatacagatcatggatcttggacacatgtgtgatgccaccatgagctatgaatgccctatgctggatgagggggtggaaccagatgacgtcgattgttggtgcaacacgacgtcaacttgggttgtgtacggaacctgccatcacaaaaaaggtgaagcacggagatctagaagagctgtgacgctcccctcccattccactaggaagctgcaaacgcggtcgcaaacctggttggaatcaagagaatacacaaagcacttgattagagtcgaaaattggatatttaggaaccctggcttcgcgttagcagcagctgccatcgcttggcttttgggaagctcaacgagccaaaaagtcatatacttggtcatgatactgctgattgccccggcatacagcatcaggtgcataggagtcagcaatagggactttgtggaaggtatgtcaggtgggacctgggttgatgttgtcttggaacatggaggttgtgtcaccgtaatggcacaggacaaaccgactgtcgacatagagctggttacaacaacagtcagcaacatggcggaggtaagatcctactgctatgaggcatcaatatcagacatggcttcggacagccgctgcccaacacaaggtgaagcctaccttgacaagcaatcagacactcaatatgtctgcaaaagaacgttagtggacagaggctggggaaatggatgtggactttttggcaaagggagcctggtgacatgcgctaagtttgcatgctccaagaaaatgaccgggaagagcatccagccagagaatctggagtaccggataatgctgtcagttcatggctcccagcacagtgggatgattgttaatgacacaggacatgaaactgatgagaatagagcgaaagttgagataacgcccaattcaccaagagccgaagccaccctggggggttttggaagcctaggacttgattgtgaaccgaggacaggccttgacttttcagatttgtattacttgactatgaataacaagcactggttggttcacaaggagtggttccacgacattccattaccttggcacgctggggcagacaccggaactccacactggaacaacaaagaagcactggtagagttcaaggacgcacatgccaaaaggcaaactgtcgtggttctagggagtcaagaaggagcagttcacacggcccttgctggagctctggaggctgagatggatggtgcaaagggaaggctgtcctctggccacttgaaatgtcgcctgaaaatggataaacttagattgaagggcgtgtcatactccttgtgtactgcagcgttcacattcaccaagatcccggctgaaacactgcacgggacagtcacagtggaggtacagtacgcagggacagatggaccttgcaaggttccagctcagatggcggtggacatgcaaactctgaccccagttgggaggttgataaccgctaaccccgtaatcactgaaagcactgagaactctaagatgatgctggaacttgatccaccatttggggactcttacattgtcataggagtcggggagaagaagatcacccaccactggcacaggagtggcagcaccattggaaaagcatttgaagccactgtgagaggtgccaagagaatggcagtcttgggagacacagcctgggactttggatcagttggaggcgctctcaactcattgggcaagggcatccatcaaatttttggagcagctttcaaatcattgtttggaggaatgtcctggttctcacaaattctcattggaacgttgctgatgtggttgggtctgaacacaaagaatggatctatttcccttatgtgcttggccttagggggagtgttgatcttcttatccacagccgtctctgctgatgtggggtgctcggtggacttctcaaagaaggagacgagatgcggtacaggggtgttcgtctataacgacgttgaagcctggagggacaggtacaagtaccatcctgactccccccgtagattggcagcagcagtcaagcaagcctgggaagatggtatctgcgggatctcctctgtttcaagaatggaaaacatcatgtggagatcagtagaaggggagctcaacgcaatcctggaagagaatggagttcaactgacggtcgttgtgggatctgtaaaaaaccccatgtggagaggtccacagagattgcccgtgcctgtgaacgagctgccccacggctggaaggcttgggggaaatcgtacttcgtcagagcagcaaagacaaataacagctttgtcgtggatggtgacacactgaaggaatgcccactcaaacatagagcatggaacagctttcttgtggaggatcatgggttcggggtatttcacactagtgtctggctcaaggttagagaagattattcattagagtgtgatccagccgttattggaacagctgttaagggaaaggaggctgtacacagtgatctaggctactggattgagagtgagaagaatgacacatggaggctgaagagggcccatctgatcgagatgaaaacatgtgaatggccaaagtcccacacattgtggacagatggaatagaagagagtgatctgatcatacccaagtctttagctgggccactcagccatcacaataccagagagggctacaggacccaaatgaaagggccatggcacagtgaagagcttgaaattcggtttgaggaatgcccaggcactaaggtccacgtggaggaaacatgtggaacaagaggaccatctctgagatcaaccactgcaagcggaagggtgatcgaggaatggtgctgcagggagtgcacaatgcccccactgtcgttccgggctaaagatggctgttggtatggaatggagataaggcccaggaaagaaccagaaagcaacttagtaaggtcaatggtgactgcaggatcaactgatcacatggaccacttctcccttggagtgcttgtgattctgctcatggtgcaggaagggctgaagaagagaatgaccacaaagatcatcataagcacatcaatggcagtgctggtagctatgatcctgggaggattttcaatgagtgacctggctaagcttgcaattttgatgggtgccaccttcgcggaaatgaacactggaggagatgtagctcatctggcgctgatagcggcattcaaagtcagaccagcgttgctggtatctttcatcttcagagctaattggacaccccgtgaaagcatgctgctggccttggcctcgtgtcttttgcaaactgcgatctccgccttggaaggcgacctgatggttctcatcaatggttttgctttggcctggttggcaatacgagcgatggttgttccacgcactgataacatcaccttggcaatcctggctgctctgacaccactggcccggggcacactgcttgtggcgtggagagcaggccttgctacttgcggggggtttatgctcctctctctgaagggaaaaggcagtgtgaagaagaacttaccatttgtcatggccctgggactaaccgctgtgaggctggtcgaccccatcaacgtggtgggactgctgttgctcacaaggagtgggaagcggagctggccccctagcgaagtactcacagctgttggcctgatatgcgcattggctggagggttcgccaaggcagatatagagatggctgggcccatggccgcggtcggtctgctaattgtcagttacgtggtctcaggaaagagtgtggacatgtacattgaaagagcaggtgacatcacatgggaaaaagatgcggaagtcactggaaacagtccccggctcgatgtggcgctagatgagagtggtgatttctccctggtggaggatgacggtccccccatgagagagatcatactcaaggtggtcctgatgaccatctgtggcatgaacccaatagccataccctttgcagctggagcgtggtacgtatacgtgaagactggaaaaaggagtggtgctctatgggatgtgcctgctcccaaggaagtaaaaaagggggagaccacagatggagtgtacagagtaatgactcgtagactgctaggttcaacacaagttggagtgggagttatgcaagagggggtctttcacactatgtggcacgtcacaaaaggatccgcgctgagaagcggtgaagggagacttgatccatactggggagatgtcaagcaggatctggtgtcatactgtggtccatggaagctagatgccgcctgggacgggcacagcgaggtgcagctcttggccgtgccccccggagagagagcgaggaacatccagactctgcccggaatatttaagacaaaggatggggacattggagcggttgcgctggattacccagcaggaacttcaggatctccaatcctagacaagtgtgggagagtgataggactttatggcaatggggtcgtgatcaaaaatgggagttatgttagtgccatcacccaagggaggagggaggaagagactcctgttgagtgcttcgagccttcgatgctgaagaagaagcagctaactgtcttagacttgcatcctggagctgggaaaaccaggagagttcttcctgaaatagtccgtgaagccataaaaacaagactccgcaccgtgatcttagctccaaccagggttgtcgctgctgaaatggaggaggcccttagagggcttccagtgcgttatatgacaacagcagtcaatgtcacccactctggaacagaaatcgtcgacttaatgtgccatgccaccttcacttcacgtctactacagccaatcagagtccccaactataatctgtatattatggatgaggcccacttcacagatccctcaagtatagcagcaagaggatacatttcaacaagggttgagatgggcgaggcggctgccatcttcatgaccgccacgccaccaggaacccgtgacgcatttccggactccaactcaccaattatggacaccgaagtggaagtcccagagagagcctggagctcaggctttgattgggtgacggatcattctggaaaaacagtttggtttgttccaagcgtgaggaacggcaatgagatcgcagcttgtctgacaaaggctggaaaacgggtcatacagctcagcagaaagacttttgagacagagttccagaaaacaaaacatcaagagtgggactttgtcgtgacaactgacatttcagagatgggcgccaactttaaagctgaccgtgtcatagattccaggagatgcctaaagccggtcatacttgatggcgagagagtcattctggctggacccatgcctgtcacacatgccagcgctgcccagaggagggggcgcataggcaggaatcccaacaaacctggagatgagtatctgtatggaggtgggtgcgcagagactgacgaagaccatgcacactggcttgaagcaagaatgctccttgacaatatttacctccaagatggcctcatagcctcgctctatcgacctgaggccgacaaagtagcagccattgagggagagttcaagcttaggacggagcaaaggaagacctttgtggaactcatgaaaagaggagatcttcctgtttggctggcctatcaggttgcatctgccggaataacctacacagatagaagatggtgctttgatggcacgaccaacaacaccataatggaagacagtgtgccggcagaggtgtggaccagacacggagagaaaagagtgctcaaaccgaggtggatggacgccagagtttgttcagatcatgcggccctgaagtcattcaaggagtttgccgctgggaaaagaggagcggcttttggagtgatggaagccctgggaacactgccaggacacatgacagagagattccaggaagccattgacaacctcgctgtgctcatgcgggcagagactggaagcaggccttacaaagccgcggcggcccaattgccggagaccctagagaccattatgcttttggggttgctgggaacagtctcgctgggaatcttcttcgtcttgatgaggaacaagggcatagggaagatgggctttggaatggtgactcttggggccagcgcatggctcatgtggctctcggaaattgagccagccagaattgcatgtgtcctcattgttgtgtttctattgctggtggtgctcatacctgagccagaaaagcaaagatctccccaggacaaccaaatggcaatcatcatcatggtagcagtaggtcttctgggcttgattaccgccaatgaactcggatggttggagagaacaaagagtgacctaagccatctaatgggaaggagagaggagggggcaaccataggattctcaatggacattgacctgcggccagcctcagcttgggccatctatgctgccttgacaactttcattaccccagccgtccaacatgcagtgaccacttcatacaacaactactccttaatggcgatggccacgcaagctggagtgttgtttggtatgggcaaagggatgccattctacgcatgggactttggagtcccgctgctaatgataggttgctactcacaattaacacccctgaccctaatagtggccatcattttgctcgtggcgcactacatgtacttgatcccagggctgcaggcagcagctgcgcgtgctgcccagaagagaacggcagctggcatcatgaagaaccctgttgtggatggaatagtggtgactgacattgacacaatgacaattgacccccaagtggagaaaaagatgggacaggtgctactcatagcagtagccgtctccagcgccatactgtcgcggaccgcctgggggtggggggaggctggggccctgatcacagccgcaacttccactttgtgggaaggctctccgaacaagtactggaactcctctacagccacttcactgtgtaacatttttaggggaagttacttggctggagcttctctaatctacacagtaacaagaaacgctggcttggtcaagagacgtgggggtggaacaggagagaccctgggagagaaatggaaggcccgcttgaaccagatgtcggccctggagttctactcctacaaaaagtcaggcatcaccgaggtgtgcagagaagaggcccgccgcgccctcaaggacggtgtggcaacgggaggccatgctgtgtcccgaggaagtgcaaagctgagatggttggtggagcggggatacctgcagccctatggaaaggtcattgatcttggatgtggcagagggggctggagttactacgccgccaccatccgcaaagttcaagaagtgaaaggatacacaaaaggaggccctggtcatgaagaacccgtgttggtgcaaagctatgggtggaacatagtccgtcttaagagtggggtggacgtctttcatatggcggctgagccgtgtgacacgttgctgtgtgacataggtgagtcatcatctagtcctgaagtggaagaagcacggacgctcagagtcctctccatggtgggggattggcttgaaaaaagaccaggagccttttgtataaaggtgttgtgcccatacaccagcactatgatggaaaccctggagcgactgcagcgtaggtatgggggaggactggtcagagtgccactctcccgcaactctacacatgagatgtattgggtctctggagcgaaaagcaacaccataaaaagtgtgtccaccacgagccagctcctcttggggcgcatggacgggcctaggaggccagtgaaatatgaggaggatgtggatctcggctctggcacgcgggctgtggtaagctgcgctgaagctcccaacatgaagatcattggtaaccgcattgaaaggatccgcagtgagcacgcggaaacgtggttctttgacgagaaccacccatataggacatgggcttaccatggaagctatgaggcccccacacaagggtcagcgtcctctctaataaacggggttgtcaggctcctgtcaaaaccctgggatgtggtgactggagtcacaggaatagccatgaccgacaccacaccgtatggtcagcaaagagttttcaaggaaaaagtggacactagggtgccagacccccaagaaggcactcgtcaggttatgagcatggtctcttcctggttgtggaaagagctaggcaaacacaaacggccacgagtctgtaccaaagaagagttcatcaacaaggttcgtagcaatgcagcattaggggcaatatttgaagaggaaaaagagtggaagactgcagtggaagctgtgaacgatccaaggttctgggctctagtggataaggaaagagagcaccacctgagaggagagtgccagagttgtgtgtacaacatgatgggaaaaagagaaaagaaacaaggggaatttggaaaggccaagggcagccgcgccatctggtatatgtggctaggggctagatttctagagttcgaagcccttggattcttgaacgaggatcactggatggggagagagaactcaggaggtggtgttgaagggctgggattacaaagactcggatatgtcctagaagagatgagtcgtataccaggaggaaggatgtatgcagatgacactgctggctgggacacccgcatcagcaggtttgatctggagaatgaagctctaatcaccaaccaaatggaaaaagggcacagggccttggcattggccataatcaagtacacataccaaaacaaagtggtaaaggtccttagaccagctgaaaaagggaaaacagttatggacattatttcgagacaagaccaaagggggagcggacaagttgtcacttacgctcttaacacatttaccaacctagtggtgcaactcattcggaatatggaggctgaggaagttctagagatgcaagacttgtggctgctgcggaggtcagagaaagtgaccaactggttgcagagcaacggatgggataggctcaaacgaatggcagtcagtggagatgattgcgttgtgaagccaattgatgataggtttgcacatgccctcaggttcttgaatgatatgggaaaagttaggaaggacacacaagagtggaaaccctcaactggatgggacaactgggaagaagttccgttttgctcccaccacttcaacaagctccatctcaaggacgggaggtccattgtggttccctgccgccaccaagatgaactgattggccgggcccgcgtctctccaggggcgggatggagcatccgggagactgcttgcctagcaaaatcatatgcgcaaatgtggcagctcctttatttccacagaagggacctccgactgatggccaatgccatttgttcatctgtgccagttgactgggttccaactgggagaactacctggtcaatccatggaaagggagaatggatgaccactgaagacatgcttgtggtgtggaacagagtgtggattgaggagaacgaccacatggaagacaagaccccagttacgaaatggacagacatcccctatttgggaaaaagggaagacttgtggtgtggatctctcatagggcacagaccgcgcaccacctgggctgagaacattaaaaacacagtcaacatggtgcgcaggatcataggtgatgaagaaaagtacatggactacctatccacccaagttcgctacttgggtgaagaagggtctacacctggagtgctgtaagcaccagtcttaatgttgtcaggcctgctagtcagccacagcttggggaaagctgtgcagcctgtgaccccccaggagaagctgggaaaccaagcctatagtcaggccgagaacgccatggcacggaagaagccatgctgcctgtgagcccctcagaggacactgagtcaaaaaaccccacgcgcttggaggcgcaggatgggaaaagaaggtggcgaccttccccacccttcaatctggggcctgaactggagatcagctgtggatctccagaagagggactagtggttagaggag

SEQ ID NO: 2 - DNA, 10648 bp, Zika virus
  Isolate SSABR1, complete genome
gacagttcgagtttgaagcgaaagctagcaacagtatcaacaggttttatttggatttggaaacgagagtttctggtcatgaaaaacccaaaaaagaaatccggaggattccggattgtcaatatgctaaaacgcggagtagcccgtgtgagcccctttgggggcttgaagaggctgccagccggacttctgctgggtcatgggcccatcaggatggtcttggcgattctagcctttttgagattcacggcaatcaagccatcactgggtctcatcaatagatggggttcagtggggaaaaaagaggctatggaaataataaagaagttcaagaaagatctggctgccatgctgagaataatcaatgctaggaaggagaagaagagacgaggcgcagatactagtgtcggaattgttggcctcctgctgaccacagctatggcagcggaggtcactagacgtgggagtgcatactatatgtacttggacagaaacgatgctggggaggccatatcttttccaaccacattggggatgaataagtgttatatacagatcatggatcttggacacatgtgtgatgccaccatgagctatgaatgccctatgctggatgagggggtggaaccagatgacgtcgattgttggtgcaacacgacgtcaacttgggttgtgtacggaacctgccatcacaaaaaaggtgaagcacggagatctagaagagctgtgacgctcccctcccattccactaggaagctgcaaacgcggtcgcaaacctggttggaatcaagagaatacacaaagcacttgattagagtcgaaaattggatattcaggaaccctggcttcgcgttagcagcagctgccatcgcttggcttttgggaagctcaacgagccaaaaagtcatatacttggtcatgatactgctgattgccccggcatacagcatcaggtgcataggagtcagcaatagggactttgtggaaggtatgtcaggtgggacctgggttgatgttgtcttggaacatggaggttgtgtcaccgtaatggcacaggacaaaccgactgtcgacatagagctggttacaacaacagtcagcaacatggcggaggtaagatcctactgctatgaggcatcaatatcagacatggcttcggacagccgctgcccaacacaaggtgaagcctaccttgacaagcaatcagacactcaatatgtctgcaaaagaacgttagtggacagaggctggggaaatggatgtggactttttggcaaagggagcctggtgacatgcgctaagtttgcatgctccaagaaaatgaccgggaagagcatccagccagagaatctggagtaccggataatgctgtcagttcatggctcccagcacagtgggatgattgttaatgacacaggacatgaaactgatgagaatagagcgaaagttgagataacgcccaattcaccaagagccgaagccaccctggggggttttggaagcctaggacttgattgtgaaccgaggacaggccttgacttttcagatttgtattacttgactatgaataacaagcactggttggttcacaaggagtggttccacgacattccattaccttggcacgctggggcagacaccggaactccacactggaacaacaaagaagcactggtagagttcaaggacgcacatgccaaaaggcaaactgtcgtggttctagggagtcaagaaggagcagttcacacggcccttgctggagctctggaggctgagatggatggtgcaaagggaaggctgtcctctggccacttgaaatgtcgcctgaaaatggataaacttagattgaagggcgtgtcatactccttgtgtactgcagcgttcacattcaccaagatcccggctgaaacactgcacgggacagtcacagtggaggtacagtacgcagggacagatggaccttgcaaggttccagctcagatggcggtggacatgcaaactctgaccccagttgggaggttgataaccgctaaccccgtaatcactgaaagcactgagaactctaagatgatgctggaacttgatccaccatttggggactcttacattgtcataggagtcggggagaagaagatcacccaccactggcacaggagtggcagcaccattggaaaagcatttgaagccactgtgagaggtgccaagagaatggcagtcttgggagacacagcctgggactttggatcagttggaggcgctctcaactcattgggcaagggcatccatcaaatttttggagcagctttcaaatcattgtttggaggaatgtcctggttctcacaaattctcattggaacgttgctgatgtggttgggtctgaacacaaagaatggatctatttcccttatgtgcttggccttagggggagtgttgatcttcttatccacagccgtctctgctgatgtggggtgctcggtggacttctcaaagaaggagacgagatgcggtacaggggtgttcgtctataacgacgttgaagcctggagggacaggtacaagtaccatcctgactccccccgtagattggcagcagcagtcaagcaagcctgggaagatggtatctgcgggatctcctctgtttcaagaatggaaaacatcatgtggagatcagtagaaggggagctcaacgcaatcctggaagagaatggagttcaactgacggtcgttgtgggatctgtaaaaaaccccatgtggagaggtccacagagattgcccgtgcctgtgaacgagctgccccacggctggaaggcttgggggaaatcgtacttcgtcagagcagcaaagacaaataacagctttgtcgtggatggtgacacactgaaggaatgcccactcaaacatagagcatggaacagctttcttgtggaggatcatgggttcggggtatttcacactagtgtctggctcaaggttagagaagattattcattagagtgtgatccagccgttattggaacagctgttaagggaaaggaggctgtacacagtgatctaggctactggattgagagtgagaagaatgacacatggaggctgaagagggcccatctgatcgagatgaaaacatgtgaatggccaaagtcccacacattgtggacagatggaatagaagagagtgatctgatcatacccaagtctttagctgggccactcagccatcacaataccagagagggctacaggacccaaatgaaagggccatggcacagtgaagagcttgaaattcggtttgaggaatgcccaggcactaaggtccacgtggaggaaacatgtggaacaagaggaccatctctgagatcaaccactgcaagcggaagggtgatcgaggaatggtgctgcagggagtgcacaatgcccccactgtcgttccgggctaaagatggctgttggtatggaatggagataaggcccaggaaagaaccagaaagcaacttagtaaggtcaatggtgactgcaggatcaactgatcacatggaccacttctcccttggagtgcttgtgattctgctcatggtgcaggaagggctgaagaagagaatgaccacaaagatcatcataagcacatcaatggcagtgctggtagctatgatcctgggaggattttcaatgagtgacctggctaagcttgcaattttgatgggtgccaccttcgcggaaatgaacactggaggagatgtagctcatctggcgctgatagcggcattcaaagtcagaccagcgttgctggtatctttcatcttcagagctaattggacaccccgtgaaagcatgctgctggccttggcctcgtgtcttttgcaaactgcgatctccgccttggaaggcgacctgatggttctcatcaatggttttgctttggcctggttggcaatacgagcgatggttgttccacgcactgataacatcaccttggcaatcctggctgctctgacaccactggcccggggcacactgcttgtggcgtggagagcaggccttgctacttgcggggggtttatgctcctctctctgaagggaaaaggcagtgtgaagaagaacttaccatttgtcatggccctgggactaaccgctgtgaggctggtcgaccccatcaacgtggtgggactgctgttgctcacaaggagtgggaagcggagctggccccctagcgaagtactcacagctgttggcctgatatgcgcattggctggagggttcgccaaggcagatatagagatggctgggcccatggccgcggtcggtctgctaattgtcagttacgtggtctcaggaaagagtgtggacatgtacattgaaagagcaggtgacatcacatgggaaaaagatgcggaagtcactggaaacagtccccggctcgatgtggcgctagatgagagtggtgatttctccctggtggaggatgacggtccccccatgagagagatcatactcaaggtggtcctgatgaccatctgtggcatgaacccaatagccataccctttgcagctggagcgtggtacgtatacgtgaagactggaaaaaggagtggtgctctatgggatgtgcctgctcccaaggaagtaaaaaagggggagaccacagatggagtgtacagagtaatgactcgtagactgctaggttcaacacaagttggagtgggagttatgcaagagggggtctttcacactatgtggcacgtcacaaaaggatccgcgctgagaagcggtgaagggagacttgatccatactggggagatgtcaagcaggatctggtgtcatactgtggtccatggaagctagatgccgcctgggacgggcacagcgaggtgcagctcttggccgtgccccccggagagagagcgaggaacatccagactctgcccggaatatttaagacaaaggatggggacattggagcggttgcgctggattacccagcaggaacttcaggatctccaatcctagacaagtgtgggagagtgataggactttatggcaatggggtcgtgatcaaaaatgggagttatgttagtgccatcacccaagggaggagggaggaagagactcctgttgagtgcttcgagccttcgatgctgaagaagaagcagctaactgtcttagacttgcatcctggagctgggaaaaccaggagagttcttcctgaaatagtccgtgaagccataaaaacaagactccgtactgtgatcttagctccaaccagggttgtcgctgctgaaatggaggaggcccttagagggcttccagtgcgttatatgacaacagcagtcaatgtcacccactctggaacagaaatcgtcgacttaatgtgccatgccaccttcacttcacgtctactacagccaatcagagtccccaactataatctgtatattatggatgaggcccacttcacagatccctcaagtatagcagcaagaggatacatttcaacaagggttgagatgggcgaggcggctgccatcttcatgaccgccacgccaccaggaacccgtgacgcatttccggactccaactcaccaattatggacaccgaagtggaagtcccagagagagcctggagctcaggctttgattgggtgacggatcattctggaaaaacagtttggtttgttccaagcgtgaggaacggcaatgagatcgcagcttgtctgacaaaggctggaaaacgggtcatacagctcagcagaaagacttttgagacagagttccagaaaacaaaacatcaagagtgggactttgtcgtgacaactgacatttcagagatgggcgccaactttaaagctgaccgtgtcatagattccaggagatgcctaaagccggtcatacttgatggcgagagagtcattctggctggacccatgcctgtcacacatgccagcgctgcccagaggagggggcgcataggcaggaatcccaacaaacctggagatgagtatctgtatggaggtgggtgcgcagagactgacgaagaccatgcacactggcttgaagcaagaatgctccttgacaatatttacctccaagatggcctcatagcctcgctctatcgacctgaggccgacaaagtagcagccattgagggagagttcaagcttaggacggagcaaaggaagacctttgtggaactcatgaaaagaggagatcttcctgtttggctggcctatcaggttgcatctgccggaataacctacacagatagaagatggtgctttgatggcacgaccaacaacaccataatggaagacagtgtgccggcagaggtgtggaccagacacggagagaaaagagtgctcaaaccgaggtggatggacgccagagtttgttcagatcatgcggccctgaagtcattcaaggagtttgccgctgggaaaagaggagcggcttttggagtgatggaagccctgggaacactgccaggacacatgacagagagattccaggaagccattgacaacctcgctgtgctcatgcgggcagagactggaagcaggccttacaaagccgcggcggcccaattgccggagaccctagagaccattatgcttttggggttgctgggaacagtctcgctgggaatcttcttcgtcttgatgaggaacaagggcatagggaagatgggctttggaatggtgactcttggggccagcgcatggctcatgtggctctcggaaattgagccagccagaattgcatgtgtcctcattgttgtgtttctattgctggtggtgctcatacctgagccagaaaagcaaagatctccccaggacaaccaaatggcaatcatcatcatggtagcagtaggtcttctgggcttgattaccgccaatgaactcggatggttggagagaacaaagagtgacctaagccatctaatgggaaggagagaggagggggcaaccataggattctcaatggacattgacctgcggccagcctcagcttgggccatctatgctgccttgacaactttcattaccccagccgtccaacatgcagtgaccacttcatacaacaactactccttaatggcgatggccacgcaagctggagtgttgtttggtatgggcaaagggatgccattctacgcatgggactttggagtcccgctgctaatgataggttgctactcacaattaacacccctgaccctaatagtggccatcattttgctcgtggcgcactacatgtacttgatcccagggctgcaggcagcagctgcgcgtgctgcccagaagagaacggcagctggcatcatgaagaaccctgttgtggatggaatagtggtgactgacattgacacaatgacaattgacccccaagtggagaaaaagatgggacaggtgctactcatagcagtagccgtctccagcgccatactgtcgcggaccgcctgggggtggggggaggctggggccctgatcacagccgcaacttccactttgtgggaaggctctccgaacaagtactggaactcctctacagccacttcactgtgtaacatttttaggggaagttacttggctggagcttctctaatctacacagtaacaagaaacgctggcttggtcaagagacgtgggggtggaacaggagagaccctgggagagaaatggaaggcccgcttgaaccagatgtcggccctggagttctactcctacaaaaagtcaggcatcaccgaggtgtgcagagaagaggcccgccgcgccctcaaggacggtgtggcaacgggaggccatgctgtgtcccgaggaagtgcaaagctgagatggttggtggagcggggatacctgcagccctatggaaaggtcattgatcttggatgtggcagagggggctggagttactacgccgccaccatccgcaaagttcaagaagtgaaaggatacacaaaaggaggccctggtcatgaagaacccgtgttggtgcaaagctatgggtggaacatagtccgtcttaagagtggggtggacgtctttcatatggcggctgagccgtgtgacacgttgctgtgtgacataggtgagtcatcatctagtcctgaagtggaagaagcacggacgctcagagtcctctccatggtgggggattggcttgaaaaaagaccaggagccttttgtataaaggtgttgtgcccatacaccagcactatgatggaaaccctggagcgactgcagcgtaggtatgggggaggactggtcagagtgccactctcccgcaactctacacatgagatgtattgggtctctggagcgaaaagcaacaccataaaaagtgtgtccaccacgagccagctcctcttggggcgcatggacgggcctaggaggccagtgaaatatgaggaggatgtgaatctcggctctggcacgcgggctgtggtaagctgcgctgaagctcccaacatgaagatcattggtaaccgcattgaaaggatccgcagtgagcacgcggaaacgtggttctttgacgagaaccacccatataggacatgggcttaccatggaagctatgaggcccccacacaagggtcagcgtcctctctaataaacggggttgtcaggctcctgtcaaaaccctgggatgtggtgactggagtcacaggaatagccatgaccgacaccacaccgtatggtcagcaaagagttttcaaggaaaaagtggacactagggtgccagacccccaagaaggcactcgtcaggttatgagcatggtctcttcctggttgtggaaagagctaggcaaacacaaacggccacgagtctgtaccaaagaagagttcatcaacaaggttcgtagcaatgcagcattaggggcaatatttgaagaggaaaaagagtggaagactgcagtggaagctgtgaacgatccaaggttctgggctctagtggataaggaaagagagcaccacctgagaggagagtgccagagttgtgtgtacaacatgatgggaaaaagagaaaagaaacaaggggaatttggaaaggccaagggcagccgcgccatctggtatatgtggctaggggctagatttctagagttcgaagcccttggattcttgaacgaggatcactggatggggagagagaactcaggaggtggtgttgaagggctgggattacaaagactcggatatgtcctagaagagatgagtcgtataccaggaggaaggatgtatgcagatgacactgctggctgggacacccgcatcagcaggtttgatctggagaatgaagctctaatcaccaaccaaatggaaaaagggcacagggccttggcattggccataatcaagtacacataccaaaacaaagtggtaaaggtccttagaccagctgaaaaagggaaaacagttatggacattatttcgagacaagaccaaagggggagcggacaagttgtcacttacgctcttaacacatttaccaacctagtggtgcaactcattcggaatatggaggctgaggaagttctagagatgcaagacttgtggctgctgcggaggtcagagaaagtgaccaactggttgcagagcaacggatgggataggctcaaacgaatggcagtcagtggagatgattgcgttgtgaagccaattgatgataggtttgcacatgccctcaggttcttgaatgatatgggaaaagttaggaaggacacacaagagtggaaaccctcaactggatgggacaactgggaagaagttccgttttgctcccaccacttcaacaagctccatctcaaggacgggaggtccattgtggttccctgccgccaccaagatgaactgattggccgggcccgcgtctctccaggggcgggatggagcatccgggagactgcttgcctagcaaaatcatatgcgcaaatgtggcagctcctttatttccacagaagggacctccgactgatggccaatgccatttgttcatctgtgccagttgactgggttccaactgggagaactacctggtcaatccatggaaagggagaatggatgaccactgaagacatgcttgtggtgtggaacagagtgtggattgaggagaacgaccacatggaagacaagaccccagttacgaaatggacagacatcccctatttgggaaaaagggaagacttgtggtgtggatctctcatagggcacagaccgcgcaccacctgggctgagaacattaaaaacacagtcaacatggtgcgcaggatcataggtgatgaagaaaagtacatggactacctatccacccaagttcgctacttgggtgaagaagggtctacacctggagtgctgtaagcaccagtcttaatgttgtcaggcctgctagtcagccacagcttggggaaagctgtgcagcctgtgacccccccaggagaagctgggaaaccaagcctatagtcaggccgagaacgccatggcacggaagaagccatgctgcctgtgagcccctcagaggacactgagtcaaaaaaccccacgcgcttggaggcgcaggatgggaaaagaaggtggcgaccttccccacccttcaatctggggcctgaactggagatcagctgtggatctccagaagagggactagtggttagaggag

SEQ ID NO: 3 - DNA, 10808 bp, Zika virus
  Strain Natal RGN, complete genome
agttgttgatctgtgtgaatcagactgcgacagttcgagtttgaagcgaaagctagcaacagtatcaacaggttttattttggatttggaaacgagagtttctggtcatgaaaaacccaaaaaagaaatccggaggattccggattgtcaatatgctaaaacgcggagtagcccgtgtgagcccctttgggggcttgaagaggctgccagccggacttctgctgggtcatgggcccatcaggatggtcttggcaattctagcctttttgagattcacggcaatcaagccatcactgggtctcatcaatagatggggttcagtggggaaaaaagaggctatggaaataataaagaagttcaagaaagatctggctgccatgctgagaataatcaatgctaggaaggagaagaagagacgaggcgcagatactagtgtcggaattgttggcctcctgctgaccacagctatggcagcggaggtcactagacgtgggagtgcatactatatgtacttggacagaaacgatgctggggaggccatatcttttccaaccacattggggatgaataagtgttatatacagatcatggatcttggacacatgtgtgatgccaccatgagctatgaatgccctatgctggatgagggggtggaaccagatgacgtcgattgttggtgcaacacgacgtcaacttgggttgtgtacggaacctgccatcacaaaaaaggtgaagcacggagatctagaagagctgtgacgctcccctcccattccactaggaagctgcaaacgcggtcgcaaacctggttggaatcaagagaatacacaaagcacttgattagagtcgaaaattggatattcaggaaccctggcttcgcgttagcagcagctgccatcgcttggcttttgggaagctcaacgagccaaaaagtcatatacttggtcatgatactgctgattgccccggcatacagcatcaggtgcataggagtcagcaatagggactttgtggaaggtatgtcaggtgggacttgggttgatgttgtcttggaacatggaggttgtgtcaccgtaatggcacaggacaaaccgactgtcgacatagagctggttacaacaacagtcagcaacatggcggaggtaagatcctactgctatgaggcatcaatatcagacatggcttcggacagccgctgcccaacacaaggtgaagcctaccttgacaagcaatcagacactcaatatgtctgcaaaagaacgttagtggacagaggctggggaaatggatgtggactttttggcaaagggagcctggtgacatgcgctaagtttgcatgctccaagaaaatgaccgggaagagcatccagccagagaatctggagtaccggataatgctgtcagttcatggctcccagcacagtgggatgatcgttaatgacacaggacatgaaactgatgagaatagagcgaaggttgagataacgcccaattcaccaagagccgaagccaccctggggggttttggaagcctaggacttgattgtgaaccgaggacaggccttgacttttcagatttgtattacttgactatgaataacaagcactggttggtccacaaggagtggttccacgacattccattaccttggcacgctggggcagacaccggaactccacactggaacaacaaagaagcactggtagagttcaaggacgcacatgccaaaaggcaaactgtcgtggttctagggagtcaagaaggagcagttcacacggcccttgctggagctctggaggctgagatggatggtgcaaagggaaggctgtcctctggccacttgaaatgtcgcctgaaaatggataaacttagattgaagggcgtgtcatactccttgtgtaccgcagcgttcacattcaccaagatcccggctgaaacactgcacgggacagtcacagtggaggtacagtacgcagggacagatggaccttgcaaggttccagctcagatggcggtggacatgcaaactctgaccccagttgggaggttgataaccgctaaccccgtaatcactgaaagcactgagaactctaagatgatgctggaacttgatccaccatttggggactcttacattgtcataggagtcggggagaagaagatcacccaccactggcacaggagtggcagcaccattggaaaagcatttgaagccactgtgagaggtgccaagagaatggcagtcttgggagacacagcctgggactttggatcagttggaggcgctctcaactcattgggcaagggcatccatcaaatttttggagcagctttcaaatcattgtttggaggaatgtcctggttctcacaaatcctcattggaacgttgctgatgtggttgggtctgaacacaaagaatggatctatttcccttatgtgcttggccttagggggagtgttgatcttcttatccacagccgtctctgctgatgtggggtgctcggtggacttctcaaagaaggagacgagatgcggtacaggggtgttcgtctataacgacgttgaagcctggagggacaggtacaagtaccatcctgactccccccgtagattggcagcagcagtcaagcaagcctgggaagatggtatctgcgggatctcctctgtttcaagaatggagaacatcatgtggagatcagtagaaggggagctcaacgcaatcttggaagagaatggagttcaactgacggtcgttgtgggatctgtaaaaaaccccatgtggagaggtccacagagattgcccgtgcctgtgaacgagctgccccacggctggaaggcttgggggaaatcgtacttcgtcagagcagcaaagacaaataacagctttgtcgtggatggtgacacactgaaggaatgcccactcgaacatagagcatggaacagctttcttgtggaggatcatgggttcggggtatttcacactagtgtctggctcaaggttagagaagattattcattagagtgtgatccagccgttattggaacagctgttaaggggaaggaggctgtacacagtgatctaggctactggattgagagtgagaagaatgacacatggaggctgaagagggcccatctaatcgagatgaaaacatgtgaatggccaaagtcccacacattgtgggcagatggaatagaagagagtgatctgatcattcccaagtctttagctgggccactcagccatcacaataccagagagggctacaggacccaaatgaaagggccatggcacagtgaagagcttgaaattcggtttgaggaatgcccgggcactaaggtccacgtggaggaaacatgtggaacaagaggaccatctctgagatcaaccactgcaagcggaagggtgatcgaggaatggtgctgcagggagtgcacaatgcccccactgtcgttccgggctaaagatggctgttggtatggaatggagataaggcccaggaaagaaccagaaagcaacttagtaaggtcagtggtgactgcaggatcaactgatcacatggatcacttctcccttggagtgcttgtgattctgctcatggtgcaggaagggctgaagaagagaatgaccacaaagatcatcataagcacatcaatggcagtgctggtagctatgatcctgggaggattttcaatgagtgacctggctaagcttgcaattttgatgggcgccaccttcgcggaaatgaacactggaggagatgtagctcatctggcgctgatagcggcattcaaagtcagaccagcgttgctggtatctttcatcttcagagctaattggacaccccgtgaaagcatgctgctggccttggcctcgtgtcttttgcaaactgcgatctccgccttggaaggcgacctgatggttctcatcaatggttttgctttggcctggttggcaatacgagcgatggttgttccacgcactgataacatcaccttggcaatcctggctgctctgacaccactggcccggggcacactgcttgtggcgtggagagcaggccttgctacttgcggggggtttatgctcctctctctgaagggaaaaggcagtgtgaagaagaacttaccatttgtcatggccctgggactaaccgctgtgaggctggtcgaccccatcaacgtggtgggactgctgttgctcacaaggagtgggaagcggagctggccccctagcgaagtactcacagctgttggcctgatatgcgcattggctggagggttcgccaaggcagatatagagatggctgggcccatggccgcggtcggtctgctaattgtcagttacgtggtctcaggaaagagtgtggacatgtacattgaaagagcaggtgacatcacatgggaaaaagatgcggaagtcactggaaacagtccccggctcgatgtggcgctagatgagagtggtgatttctccctggtggaggatgacggtccccccatgagagagatcatactcaaggtggtcctgatgaccatctgtggcatgaacccaatagccataccctttgcagctggagcgtggtacgtatacgtgaagactggaaaaaggagtggtgctctatgggatgtgcctgctcccaaggaagtaaaaaagggggagaccacagatggagtgtacagagtaatgactcgtagactgctaggttcaacacaagttggagtgggagttatgcaagagggggtctttcacactatgtggcacgtcacaaaaggatccgcgctgagaagcggtgaagggagacttgatccatactggggagatgtcaagcaggatctggtgtcatactgtggtccatggaagctagatgccgcctgggacgggcacagcgaggtgcagctcttggccgtgccccccggagagagagcgaggaacatccagactctgcccggaatatttaagacaaaggatggggacattggagcggttgcgctggattacccagcaggaacttcaggatctccaatcctagacaagtgtgggagagtgataggactttatggcaatggggtcgtgatcaaaaatgggagttatgttagtgccatcacccaagggaggagggaggaagagactcctgttgagtgcttcgagccttcgatgctgaagaagaagcagctaactgtcttagacttgcatcctggagctgggaaaaccaggagagttcttcctgaaatagtccgtgaagccataaaaacaagactccgtactgtgatcttagctccaaccagggttgtcgctgctgaaatggaggaagcccttagagggcttccagtgcgttatatgacaacagcagtcaatgtcacccactctggaacagaaatcgtcgacttaatgtgccatgccaccttcacttcacgtctactacagccaatcagagtccccaactataatctgtatattatggatgaggcccacttcacagatccctcaagtatagcagcaagaggatacatttcaacaagggttgagatgggcgaggcggctgccatcttcatgaccgccacgccaccaggaacccgtgacgcatttccggactccaactcaccaattatggacaccgaagtggaagtcccagagagagcctggagctcaggctttgattgggtgacggatcattctggaaaaacagtttggtttgttccaagcgtgaggaacggcaatgagatcgcagcttgtctgacaaaggctggaaaacgggtcatacagctcagcagaaagacttttgagacagagttccagaaaacaaaacatcaagagtgggactttgtcgtgacaactgacatttcagagatgggcgccaactttaaagctgaccgtgtcatagattccaggagatgcctaaagccggtcatacttgatggcgagagagtcattttggctggacccatgcctgtcacacatgccagcgctgcccagaggagggggcgcataggcaggaatcccaacaaacctggagatgagtatctgtatggaggtgggtgcgcagagactgacgaagaccatgcacactggcttgaagcaagaatgctccttgacaatatttacctccaagatggcctcatagcctcgctctatcgacctgaggccgacaaagtagcagccattgagggagagttcaagcttaggacggagcaaaggaagacctttgtggaactcatgaaaagaggagatcttcctgtttggctggcctatcaggttgcatctgccggaataacctacacagatagaagatggtgctttgatggcacgaccaacaacaccataatggaagacagtgtgccggcagaggtgtggaccagacacggagagaaaagagtgctcaaaccgaggtggatggacgccagagtttgttcagatcatgcggccctgaagtcattcaaggagtttgccgctgggaaaagaggagcggcttttggagtgatggaagccctgggaacactgccaggacacatgacagagagattccaggaagccattgacaacctcgctgtgctcatgcgggcagagactggaagcaggccttacaaagccgcggcggcccaattgccggagaccctagagaccattatgcttttggggttgctgggaacagtctcgctgggaatctttttcgtcttgatgaggaacaagggcatagggaagatgggctttggaatggtgactcttggggccagcgcatggctcatgtggctctcggaaattgagccagccagaattgcatgtgtcctcattgttgtgttcctattgctggtggtgctcatacctgagccagaaaagcaaagatctccccaggacaaccaaatggcaatcatcatcatggtagcagtaggtcttctgggcttgattaccgccaatgaactcggatggttggagagaacaaagagtgacctaagccatctaatgggaaggagagaggagggagcaaccataggattctcaatggacattgacctgcggccagcctcagcttgggccatctatgctgccttgacaactttcattaccccagccgtccaacatgcagtgaccacttcatacaacaactactccttaatggcgatggccacgcaagctggagtgttgtttggtatgggcaaagggatgccattctacgcatgggactttggagtcccgctgctaatgataggttgctactcacaattaacacccctgaccctaatagtggccatcattttgctcgtggcgcactacatgtacttgatcccagggctgcaggcagcagctgcgcgtgctgcccagaagagaacggcagctggcatcatgaagaaccctgttgtggatggaatagtggtgactgacattgacacaatgacaattgacccccaagtggagaaaaagatgggacaggtgctactcatagcagtagcagtctccagcgccatactgtcgcggaccgcctgggggtggggggaggctggggccctgatcacagccgcaacttccactttgtgggaaggctctccgaacaagtactggaactcctctacagccacttcactgtgtaacatttttaggggaagttacttggctggagcttctctaatctacatagtaacaagaaacgctggcttggtcaagagacgtgggggtggaacaggagagaccctgggagagaaatggaaggcccgcttgaaccagatgtcggccctggagttctactcctacaaaaagtcaggcatcaccgaggtgtgcagagaagaggcccgccgcgccctcaaggatggtgtggcaacgggaggccatgctgtgtcccgaggaagtgcaaagctgagatggttggtggagcggggatacctgcagccctatggaaaggtcattgatcttggatgtggcagagggggctggagttactacgccgccaccatccgcaaagttcaagaagtgaaaggatacacaaaaggaggccctggtcatgaagaacccgtgttggtgcaaagctatgggtggaacatagtccgtcttaagagtggggtggacgtctttcatatggcggctgagccgtgtgacacgttgctgtgtgacataggtgagtcatcatctagtcctgaagtggaagaagcacggacgctcagagtcctctccatggtgggggattggcttgaaaaaagaccaggagccttttgtataaaagtgttgtgcccatacaccagcactatgatggaaaccctggagcgactgcagcgtaggtatgggggaggactggtcagagtgccactctcccgcaactctacacatgagatgtactgggtctctggagcgaaaagcaacaccataaaaagtgtgtccaccacgagccagctcctcttggggcgcatggacgggcctaggaggccagtgaaatatgaggaggatgtgaatctcggctctggcacgcgggctgtggtaagctgcgctgaagctcccaacatgaagatcattggtaaccgcattgaaaggatccgcagtgagcacgcggaaacgtggttctttgacgagaaccacccatataggacatgggcttaccatggaagctatgaggcccccacacaagggtcagcgtcctctctaataaacggggttgtcaggctcctgtcaaaaccctgggatgtggtgactggagtcacaggaatagccatgaccgacaccacaccgtatggtcagcaaagagttttcaaggaaaaagtggacactagggtgccagacccccaagaaggcactcgtcaggttatgagcatggtctcttcctggttgtggaaagagctaggcaaacacaaacggccacgagtctgtaccaaagaagagttcatcaacaaggttcgtagcaatgcagcattaggggcaatatttgaagaggaaaaagagtggaagactgcagtggaagctgtgaacgatccaaggttctgggctctagtggacaaggaaagagagcaccacctgagaggagagtgccagagttgtgtgtacaacatgatgggaaaaagagaaaagaaacaaggggaatttggaaaggccaagggcagccgcgccatctggtatatgtggctaggggctagatttctagagttcgaagcccttggattcttgaacgaggatcactggatggggagagagaactcaggaggtggtgttgaagggctgggattacaaagactcggatatgtcctagaagagatgagtcgcataccaggaggaaggatgtatgcagatgacactgctggctgggacacccgcatcagcaggttcgatctggagaatgaagctctaatcaccaaccaaatggagaaagggcatagggccttggcattggccataatcaagtacacataccaaaacaaagtggtaaaggtccttagaccagctgaaaaagggaaaacagttatggacattatttcgagacaagaccaaagggggagcggacaagttgtcacttacgctcttaacacatttaccaacctagtggtgcaactcattcggaatatggaggctgaggaagttctagagatgcaagacttgtggctgctgcggaggtcagagaaagtgaccaactggttgcagagcaacggatgggataggctcaaacgaatggcagtcagtggagatgattgcgttgtgaagccaattgatgataggtttgcacatgccctcaggttcttgaatgatatgggaaaagttaggaaggacacacaagagtggaaaccctcaactggatgggacaactgggaagaagttccgttttgctcccaccacttcaacaagctccatctcaaggacgggaggtccattgtggttccctgccgccaccaagatgaactgattggccgggcccgcgtctctccaggggcgggatggagcatccgggagactgcttgcctagcaaaatcatatgcgcaaatgtggcagctcctttatttccacagaagggacctccgactgatggccaatgccatttgttcatctgtgccagttgactgggttccaactgggagaactacctggtcaatccatggaaagggagaatggatgaccactgaagacatgcttgtggtgtggaacagagtgtggattgaggagaacgaccacatggaagacaagaccccagttacgaaatggacagacattccctatttgggaaaaagggaagacttgtggtgtggatctctcatagggcacagaccgcgcaccacctgggctgagaacattaaaaacacagtcaacatggtgcgcaggatcataggtgatgaagaaaagtacatggactacctatccacccaagttcgctacttgggtgaagaagggtctacacctggagtgctgtaagcaccaatcttaatgttgtcaggcctgctagtcagccacagcttggggaaagctgtgcagcctgtgacccccccaggagaagctgggaaaccaagcctatagtcaggccgagaacgccatggcacggaagaagccatgctgcctgtgagcccctcagaggacactgagtcaaaaaaccccatgcgcttggaggcgcaggatgggaaaagaaggtggcgaccttccccacccttcaatctggggcctgaactggagatcagctgtggatctccagaagagggactagtggttagaggagaccccccggaaaacgcaaaacagcatattgacgctgggaaagaccagagactccatgagtttccaccacgctggccgccaggcacagatcgccgaatagcggcggccggtgtggggaaatccatgggtctt

SEQ ID NO: 4 - DNA, 10676 bp, Zika virus
  Strain Haiti/1225/2014, complete genome
gttgttactgttgctgactcagactgcgacagttcgagtttgaagcgaaagctagcaacagtatcaacaggttttatttggatttggaaacgagagtttctggtcatgaaaaacccaaaaaagaaatccggaggattccggattgtcaatatgctaaaacgcggagtagcccgtgtgagcccctttgggggcttgaagaggctgccagccggacttctgctgggtcatgggcccatcaggatggtcttggcaattctagcctttttgagattcacggcaatcaagccatcactgggtctcatcaatagatggggttcagtggggaaaaaagaggctatggaaataataaagaagttcaagaaagatctggctgccatgctgagaataatcaatgctaggaaggagaagaagagacgaggcgcagatactagtgtcggaattgttggcctcctgctgaccacagctatggcagcggaggtcactagacgtgggagtgcatactatatgtacttggacagaaacgatgctggggaggccatatcttttccaaccacattggggatgaataagtgttatatacagatcatggatcttggacacatgtgtgatgccaccatgagctatgaatgccctatgctggatgagggggtggaaccagatgacgtcgattgttggtgcaacacgacgtcaacttgggttgtgtacggaacctgccatcacaaaaaaggtgaagcacggagatctagaagagctgtgacgctcccctcccattccactaggaagctgcaaacgcggtcgcaaacctggttggaatcaagagaatacacaaagcacttgattagagtcgaaaattggatattcaggaaccctggcttcgcgttagcagcagctgccatcgcttggcttttgggaagctcaacgagccaaaaagtcatatacttggtcatgatactgctgattgccccggcatacagcatcaggtgcataggagtcagcaatagggactttgtggaaggtatgtcaggtgggacttgggttgatgttgtcttggaacatggaggttgtgtcaccgtaatggcacaggacaaaccgactgtcgacatagagctggttacaacaacagtcagcaacatggcggaggtaagatcctactgctatgaggcatcaatatcagacatggcttcggacagccgctgcccaacacaaggtgaagcctaccttgacaagcaatcagacactcaatatgtctgcaaaagaacgttagtggacagaggctggggaaatggatgtggactttttggcaaagggagtctggtgacatgcgctaagtttgcatgctccaagaaaatgaccgggaagagcatccagccagagaatctggagtaccggataatgctgtcagttcatggctcccagcacagtgggatgatcgttaatgacacaggacatgaaactgatgagaatagagcgaaggttgagataacgcccaattcaccaagagccgaagccaccctggggggttttggaagcctaggacttgattgtgaaccgaggacaggccttgacttttcagatttgtattacttgactatgaataacaagcactggttggttcacaaggagtggttccacgacattccattaccttggcacgctggggcagacaccggaactccacactggaacaacaaagaagcactggtagagttcaaggacgcacatgccaaaaggcaaactgtcgtggttctagggagtcaagaaggagcagttcacacggcccttgctggagctctggaggctgagatggatggtgcaaagggaaggctgtcctctggccacttgaaatgtcgcctgaaaatggataaacttagattgaagggcgtgtcatactccttgtgtaccgcagcgttcacattcaccaagatcccggctgaaacactgcacgggacagtcacagtggaggtacagtacgcagggacagatggaccttgcaaggttccagctcagatggcggtggacatgcaaactctgaccccagttgggaggttgataaccgctaaccccgtaatcactgaaagcactgagaactctaagatgatgctggaacttgatccaccatttggggactcttacattgtcataggagtcggggagaagaagatcacccaccactggcacaggagtggcagcaccattggaaaagcatttgaagccactgtgagaggtgccaagagaatggcagtcttgggagacacagcctgggactttggatcagttggaggcgctctcaactcattgggcaagggcatccatcaaatttttggagcagctttcaaatcattgtttggaggaatgtcctggttctcacaaattctcattggaacgttgctgatgtggttgggtctgaacacaaagaatggatctatttcccttatgtgcttggccttagggggagtgttgatcttcttatccacagccgtctctgctgatgtggggtgctcggtggacttctcaaagaaggagacgagatgcggtacaggggtgttcgtctataacgacgttgaagcctggagggacaggtacaagtaccatcctgactccccccgtagattggcagcagcagtcaagcaagcctgggaagatggtatctgcgggatctcctctgtttcaagaatggaaaacatcatgtggagatcagtagaaggggagctcaacgcaatcctggaagagaatggagttcaactgacggtcgttgtgggatctgtaaaaaaccccatgtggagaggtccacagagattgcccgtgcctgtgaacgagctgccccacggctggaaggcttgggggaaatcgcacttcgtcagagcagcaaagacaaataacagctttgtcgtggatggtgacacactgaaggaatgcccactcaaacatagagcatggaacagctttcttgtggaggatcatgggttcggggtatttcacactagtgtctggctcaaggttagagaagattattcattagagtgtgatccagccgttattggaacagctgttaagggaaaggaggctgtacacagtgatctaggctactggattgagagtgagaagaatgacacatggaggctgaagagggcccatctgatcgagatgaaaacatgtgaatggccaaagtcccacacattgtggacagatggaatagaagagagtgatctgatcatacccaagtctttagctgggccactcagccatcacaataccagagagggctacaggacccaaatgaaagggccatggcacagtgaagagcttgaaattcggtttgaggaatgcccaggcactaaggtccacgtggaggaaacatgtggaacaagaggaccatctctgagatcaaccactgcaagcggaagggtgatcgaggaatggtgctgcagggagtgcacaatgcccccactgtcgttccgggctaaagatggctgttggtatggaatggagataaggcccaggaaagaaccagaaagcaacttagtaaggtcaatggtgactgcaggatcaactgatcacatggatcacttctcccttggagtgcttgtgattctgctcatggtgcaggaagggctgaagaagagaatgaccacaaagatcatcataagcacatcaatggcagtgctggtagctatgatcctgggaggattttcaatgagtgacctggctaagcttgcaattttgatgggtgccaccttcgcggaaatgaacactggaggagatgtagctcatctggcgctgatagcggcattcaaagtcagaccagcgttgctggtatctttcatcttcagagctaattggacaccccgtgaaagcatgctgctggccttggcctcgtgtcttttgcaaactgcgatctccgccttggaaggcgacctgatggttctcatcaatggttttgctttggcctggttggcaatacgagcgatggttgttccacgcactgataacatcaccttggcaatcctggctgctctgacaccactggcccggggcacactgcttgtggcgtggagagcaggccttgctacttgcggggggtttatgctcctctctctgaagggaaaaggcagtgtgaagaagaacttaccatttgtcatggccctgggactaaccgctgtgaggctggtcgaccccatcaacgtggtggggctgctgttgctcacaaggagtgggaagcggagctggccccctagcgaagtactcacagctgttggcctgatatgcgcattggctggagggttcgccaaggcagatatagagatggctgggcccatggccgcggtcggtctgctaattgtcagttacgtggtctcaggaaagagtgtggacatgtacattgaaagagcaggtgacatcacatgggaaaaagatgcggaagtcactggaaacagtccccggctcgatgtggcgctagatgagagtggtgatttctccctggtggaggatgacggtccccccatgagagagatcatactcaaggtggtcctgatgaccatctgtggcatgaacccaatagccataccctttgcagctggagcgtggtacgtatacgtgaagactggaaaaaggagtggtgctctatgggatgtgcctgctcccaaggaagtaaaaaagggggagaccacagatggagtgtacagagtaatgactcgtagactgctaggttcaacacaagttggagtgggagttatgcaagagggggtctttcacactatgtggcacgtcacaaaaggatccgcgctgagaagcggtgaagggagacttgatccatactggggagatgtcaagcaggatctggtgtcatactgtggtccatggaagctagatgccgcctgggacgggcacagcgaggtgcagctcttggccgtgccccccggagagagagcgaggaacatccagactctgcccggaatatttaagacaaaggatggggacattggagcggttgcgctggattacccagcaggaacttcaggatctccaatcctagacaagtgtgggagagtgataggactttatggcaatggggtcgtgatcaaaaatgggagttatgttagtgccatcacccaagggaggagggaggaagagactcctgttgagtgcttcgagccttcgatgctgaagaagaagcagctaactgtcttagacttgcatcctggagctgggaaaaccaggagagttcttcctgaaatagtccgtgaagccataaaaacaagactccgtactgtgatcttagctccaaccagggttgtcgctgctgaaatggaggaagcccttagagggcttccagtgcgttatatgacaacagcagtcaatgtcacccactctggaacagaaatcgtcgacttaatgtgccatgccaccttcacttcacgtctactacagccaatcagagtccccaactataatctgtatattatggatgaggcccacttcacagatccctcaagtatagcagcaagaggatacatttcaacaagggttgagatgggcgaggcggctgccatcttcatgaccgccacgccaccaggaacccgtgacgcatttccggactccaactcaccaattatggacaccgaagtggaagtcccagagagagcctggagctcaggctttgattgggtgacggattattctggaaaaacagtttggtttgttccaagcgtgaggaacggcaatgagatcgcagcttgtctgacaaaggctggaaaacgggtcatacagctcagcagaaagacttttgagacagagttccagaaaacaaaacatcaagagtgggactttgtcgtgacaactgacatttcagagatgggcgccaactttaaagctgaccgtgtcatagattccaggagatgcctaaagccggtcatacttgatggcgagagagtcattctggctggacccatgcctgtcacacatgccagcgctgcccagaggagggggcgcataggcaggaatcccaacaaacctggagatgagtatctgtatggaggtgggtgcgcagagactgacgaagaccatgcacactggcttgaagcaagaatgctccttgacaatatttacctccaagatggcctcatagcctcgctctatcgacctgaggccgacaaagtagcagccattgagggagagttcaagcttaggacggagcaaaggaagacctttgtggaactcatgaaaagaggagatcttcctgtttggctggcctatcaggttgcatctgccggaataacctacacagatagaagatggtgctttgatggcacgaccaacaacaccataatggaagacagtgtgccggcagaggtgtggaccagacacggagagaaaagagtgctcaaaccgaggtggatggacgccagagtttgttcagatcatgcggccctgaagtcattcaaggagtttgccgctgggaaaagaggagcggcttttggagtgatggaagccctgggaacactgccaggacacatgacagagagattccaggaagccattgacaacctcgctgtgctcatgcgggcagagactggaagcaggccttacaaagccgcggcggcccaattgccggagaccctagagaccattatgcttttggggttgctgggaacagtctcgctgggaatctttttcgtcttgatgaggaacaagggcatagggaagatgggctttggaatggtgactcttggggccagcgcatggctcatgtggctctcggaaattgagccagccagaattgcatgtgtcctcattgttgtgttcctattgctggtggtgctcatacctgagccagaaaagcaaagatctccccaggacaaccaaatggcaatcatcatcatggtagcagtaggtcttctgggcttgattaccgccaatgaactcggatggttggagagaacaaagagtgacctaagccatctaatgggaaggagagaggagggggcaaccatgggattctcaatggacattgacctgcggccagcctcagcttgggccatctatgctgccttgacaactttcattaccccagccgtccaacatgcagtgaccacttcatacaacaactactccttaatggcgatggccacgcaagctggagtgttgtttggtatgggcaaagggatgccattctacgcatgggactttggagtcccgctgctaatgataggttgctactcacaattaacgcccctgaccctaatagtggccatcattttgctcgtggcgcactacatgtacttgatcccagggctgcaggcagcagctgcgcgtgctgcccagaagagaacggcagctggcatcatgaagaaccctgttgtggatggaatagtggtgactgacattgacacaatgacaattgacccccaagtggagaaaaagatgggacaggtgctactcatggcagtagccgtctccagcgccatactgtcgcggaccgcctgggggtggggggaggctggggccctgatcacagccgcaacttccactttgtgggaaggctctccgaacaagtactggaactcctctacagccacttcactgtgtaacatttttaggggaagttacttggctggagcttctctaatctacacagtaacaagaaacgctggcttggtcaagagacgtgggggtggaacaggagagaccctgggagagaaatggaaggcccgcttgaaccagatgtcggccctggagttctactcctacaaaaagtcaggcatcaccgaggtgtgcagagaagaggcccgccgcgccctcaaggacggtgtggcaacgggaggccatgctgtgtcccgaggaagtgcaaagctgagatggttggtggagcggggatacctgcagccctatggaaaggtcattgatcttggatgtggcagagggggctggagttactacgccgccaccatccgcaaagttcaagaagtgaaaggatacacaaaaggaggccctggtcatgaagaacccgtgttggtgcaaagctatgggtggaacatagtccgtcttaagagtggggtggacgtctttcatatggcggctgagccgtgtgacacgttgctgtgtgacataggtgagtcatcatctagtcctgaagtggaagaagcacggacgctcagagtcctctccatggtgggggattggcttgaaaaaagaccaggagccttttgtataaaagtgttgtgcccatacaccagcactatgatggaaaccctggagcgactgcagcgtaggtatgggggaggactggtcagagtgccactctcccgcaactctacacatgagatgtactgggtctctggagcgaaaagcaacaccataaaaagtgtgtccaccacgagccagctcctcttggggcgcatggacgggcctaggaggccagtgaaatatgaggaggatgtgaatctcggctctggcacgcgggctgtggtaagctgcgctgaagctcccaacatgaagatcattggtaaccgcattgaaaggatccgcagtgagcacgcggaaacgtggttctttgacgagaaccacccatataggacatgggcttaccatggaagctatgaggcccccacacaagggtcagcgtcctctctaataaacggggttgtcaggctcctgtcaaaaccctgggatgtggtgactggagtcacaggaatagccatgaccgacaccacaccgtatggtcagcaaagagttttcaaggaaaaagtggacactagggtgccagacccccaagaaggcactcgtcaggttatgagcatggtctcttcctggttgtggaaagagctaggcaaacacaaacggccacgagtctgtaccaaagaagagttcatcaacaaggttcgtagcaatgcagcattaggggcaatatttgaagaggaaaaagagtggaagactgcagtggaagctgtgaacgatccaaggttctgggctctagtggacaaggaaagagagcaccacctgagaggagagtgccagagttgtgtgtacaacatgatgggaaaaagagaaaagaaacaaggggaatttggaaaggccaagggcagccgcgccatctggtatatgtggctaggggctagatttctagagttcgaagcccttggattcttgaacgaggatcactggatggggagagagaactcaggaggtggtgttgaagggctgggattacaaagactcggatatgtcctagaagagatgagtcgcataccaggaggaaggatgtatgcagatgacactgctggctgggacacccgcatcagcaggtttgatctggagaatgaagctctaatcaccaaccaaatggagaaagggcacagggccttggcattggccataatcaagtacacataccaaaacaaagtggtaaaggtccttagaccagctgaaaaagggaagacagttatggacattatttcgagacaagaccaaagggggagcggacaagttgtcacttacgctcttaacacatttaccaacctagtggtgcaactcattcggaatatggaggctgaggaagttctagagatgcaagacttgtggctgctgcggaggtcagagaaagtgaccaactggttgcagagcaacggatgggataggctcaaacgaatggcagtcagtggagatgattgcgttgtgaagccaattgatgataggtttgcacatgccctcaggttcttgaatgatatgggaaaagttaggaaggacacacaagagtggaaaccctcaactggatgggacaactgggaagaagttccgttttgctcccaccacttcaacaagctccatctcaaggacgggaggtccattgtggttccctgccgccaccaagatgaactgattggccgggcccgcgtctctccaggggcgggatggagcatccgggagactgcttgcctagcaaaatcatatgcgcaaatgtggcagctcctttatttccacagaagggacctccgactgatggccaatgccatttgttcatctgtgccagttgactgggttccaactgggagaactacctggtcaatccatggaaagggagaatggatgaccactgaagacatgcttgtggtgtggaacagagtgtggattgaggagaacgaccacatggaagacaagaccccagttacgaaatggacagacattccctatttgggaaaaagggaagacttgtggtgtggatctctcatagggcacagaccgcgcaccacctgggctgagaacattaaaaacacagtcaacatggtgcgcaggatcataggtgatgaagaaaagtacatggactacctatccacccaagttcgctacttgggtgaagaagggtctacacctggagtgctgtaagcaccaatcttaatgttgtcaggcctgctagtcagccacagcttggggaaagctgtgcagcctgtgacccccccaggagaagctgggaaaccaagcctatagtcaggccgagaacgccatggcacggaagaagccatgctgcctgtgagcccctcagaggacactgagtcaaaaaaccccacgcgcttggaggcgcaggatgggaaaagaaggtggcgaccttccccacccttcaatctggggcctgaactggagatcagctgtggatctccagaagagggactagtggttagaggaga

SEQ ID NO: 5 - DNA, 10675 bp, Zika virus
  Strain PRVABC59
gttgttgatctgtgtgaatcagactgcgacagttcgagtttgaagcgaaagctagcaacagtatcaacaggttttattttggatttggaaacgagagtttctggtcatgaaaaacccaaaaaagaaatccggaggattccggattgtcaatatgctaaaacgcggagtagcccgtgtgagcccctttgggggcttgaagaggctgccagccggacttctgctgggtcatgggcccatcaggatggtcttggcgattctagcctttttgagattcacggcaatcaagccatcactgggtctcatcaatagatggggttcagtggggaaaaaagaggctatggaaacaataaagaagttcaagaaagatctggctgccatgctgagaataatcaatgctaggaaggagaagaagagacgaggcgcagatactagtgtcggaattgttggcctcctgctgaccacagctatggcagcggaggtcactagacgtgggagtgcatactatatgtacttggacagaaacgatgctggggaggccatatcttttccaaccacattggggatgaataagtgttatatacagatcatggatcttggacacatgtgtgatgccaccatgagctatgaatgccctatgctggatgagggggtggaaccagatgacgtcgattgttggtgcaacacgacgtcaacttgggttgtgtacggaacctgccatcacaaaaaaggtgaagcacggagatctagaagagctgtgacgctcccctcccattccaccaggaagctgcaaacgcggtcgcaaacctggttggaatcaagagaatacacaaagcacttgattagagtcgaaaattggatattcaggaaccctggcttcgcgttagcagcagctgccatcgcttggcttttgggaagctcaacgagccaaaaagtcatatacttggtcatgatactgctgattgccccggcatacagcatcaggtgcataggagtcagcaatagggactttgtggaaggtatgtcaggtgggacttgggttgatgttgtcttggaacatggaggttgtgtcaccgtaatggcacaggacaaaccgactgtcgacatagagctggttacaacaacagtcagcaacatggcggaggtaagatcctactgctatgaggcatcaatatcagacatggcttctgacagccgctgcccaacacaaggtgaagcctaccttgacaagcaatcagacactcaatatgtctgcaaaagaacgttagtggacagaggctggggaaatggatgtggactttttggcaaagggagcctggtgacatgcgctaagtttgcatgctccaagaaaatgaccgggaagagcatccagccagagaatctggagtaccggataatgctgtcagttcatggctcccagcacagtgggatgatcgttaatgacacaggacatgaaactgatgagaatagagcgaaagttgagataacgcccaattcaccgagagccgaagccaccctggggggttttggaagcctaggacttgattgtgaaccgaggacaggccttgacttttcagatttgtattacttgactatgaataacaagcactggttggttcacaaggagtggttccacgacattccattaccttggcacgctggggcagacaccggaactccacactggaacaacaaagaagcactggtagagttcaaggacgcacatgccaaaaggcaaactgtcgtggttctagggagtcaagaaggagcagttcacacggcccttgctggagctctggaggctgagatggatggtgcaaagggaaggctgtcctctggccacttgaaatgtcgcctgaaaatggataaacttagattgaagggcgtgtcatactccttgtgtactgcagcgttcacattcaccaagatcccggctgaaacactgcacgggacagtcacagtggaggtacagtacgcagggacagatggaccttgcaaggttccagctcagatggcggtggacatgcaaactctgaccccagttgggaggttgataaccgctaaccccgtaatcactgaaagcactgagaactctaagatgatgctggaacttgatccaccatttggggactcttacattgtcataggagtcggggagaagaagatcacccaccactggcacaggagtggcagcaccattggaaaagcatttgaagccactgtgagaggtgccaagagaatggcagtcttgggagacacagcctgggactttggatcagttggaggcgctctcaactcattgggcaagggcatccatcaaatttttggagcagctttcaaatcattgtttggaggaatgtcctggttctcacaaattctcattggaacgttgctgatgtggttgggtctgaacacaaagaatggatctatttcccttatgtgcttggccttagggggagtgttgatcttcttatccacagccgtctctgctgatgtggggtgctcggtggacttctcaaagaaggagacgagatgcggtacaggggtgttcgtctataacgacgttgaagcctggagggacaggtacaagtaccatcctgactccccccgtagattggcagcagcagtcaagcaagcctgggaagatggtatctgcgggatctcctctgtttcaagaatggaaaacatcatgtggagatcagtagaaggggagctcaacgcaatcctggaagagaatggagttcaactgacggtcgttgtgggatctgtaaaaaaccccatgtggagaggtccacagagattgcccgtgcctgtgaacgagctgccccacggctggaaggcttgggggaaatcgtatttcgtcagagcagcaaagacaaataacagctttgtcgtggatggtgacacactgaaggaatgcccactcaaacatagagcatggaacagctttcttgtggaggatcatgggttcggggtatttcacactagtgtctggctcaaggttagagaagattattcattagagtgtgatccagccgttattggaacagctgttaagggaaaggaggctgtacacagtgatctaggctactggattgagagtgagaagaatgacacatggaggctgaagagggcccatctgatcgagatgaaaacatgtgaatggccaaagtcccacacattgtggacagatggaatagaagagagtgatctgatcatacccaagtctttagctgggccactcagccatcacaataccagagagggctacaggacccaaatgaaagggccatggcacagtgaagagcttgaaattcggtttgaggaatgcccaggcactaaggtccacgtggaggaaacatgtggaacaagaggaccatctctgagatcaaccactgcaagcggaagggtgatcgaggaatggtgctgcagggagtgcacaatgcccccactgtcgttccgggctaaagatggctgttggtatggaatggagataaggcccaggaaagaaccagaaagcaacttagtaaggtcaatggtgactgcaggatcaactgatcacatggaccacttctcccttggagtgcttgtgatcctgctcatggtgcaggaagggctgaagaagagaatgaccacaaagatcatcataagcacatcaatggcagtgctggtagctatgatcctgggaggattttcaatgagtgacctggctaagcttgcaattttgatgggtgccaccttcgcggaaatgaacactggaggagatgtagctcatctggcgctgatagcggcattcaaagtcagaccagcgttgctggtatctttcatcttcagagctaattggacaccccgtgaaagcatgctgctggccttggcctcgtgtcttttgcaaactgcgatctccgccttggaaggcgacctgatggttctcatcaatggttttgctttggcctggttggcaatacgagcgatggttgttccacgcactgataacatcaccttggcaatcctggctgctctgacaccactggcccggggcacactgcttgtggcgtggagagcaggccttgctacttgcggggggtttatgctcctctctctgaagggaaaaggcagtgtgaagaagaacttaccatttgtcatggccctgggactaaccgctgtgaggctggtcgaccccatcaacgtggtgggactgctgttgctcacaaggagtgggaagcggagctggccccctagcgaagtactcacagctgttggcctgatatgcgcattggctggagggttcgccaaggcagatatagagatggctgggcccatggccgcggtcggtctgctaattgtcagttacgtggtctcaggaaagagtgtggacatgtacattgaaagagcaggtgacatcacatgggaaaaagatgcggaagtcactggaaacagtccccggctcgatgtggcgctagatgagagtggtgatttctccctggtggaggatgacggtccccccatgagagagatcatactcaaggtggtcctgatgaccatctgtggcatgaacccaatagccataccctttgcagctggagcgtggtacgtatacgtgaagactggaaaaaggagtggtgctctatgggatgtgcctgctcccaaggaagtaaaaaagggggagaccacagatggagtgtacagagtaatgactcgtagactgctaggttcaacacaagttggagtgggagttatgcaagagggggtctttcacactatgtggcacgtcacaaaaggatccgcgctgagaagcggtgaagggagacttgatccatactggggagatgtcaagcaggatctggtgtcatactgtggtccatggaagctagatgccgcctgggatgggcacagcgaggtgcagctcttggccgtgccccccggagagagagcgaggaacatccagactctgcccggaatatttaagacaaaggatggggacattggagcggttgcgctggattacccagcaggaacttcaggatctccaatcctagacaagtgtgggagagtgataggactttatggcaatggggtcgtgatcaaaaacgggagttatgttagtgccatcacccaagggaggagggaggaagagactcctgttgagtgcttcgagccctcgatgctgaagaagaagcagctaactgtcttagacttgcatcctggagctgggaaaaccaggagagttcttcctgaaatagtccgtgaagccataaaaacaagactccgtactgtgatcttagctccaaccagggttgtcgctgctgaaatggaggaggcccttagagggcttccagtgcgttatatgacaacagcagtcaatgtcacccactctggaacagaaatcgtcgacttaatgtgccatgccaccttcacttcacgtctactacagccaatcagagtccccaactataatctgtatattatggatgaggcccacttcacagatccctcaagtatagcagcaagaggatacatttcaacaagggttgagatgggcgaggcggctgccatcttcatgaccgccacgccaccaggaacccgtgacgcatttccggactccaactcaccaattatggacaccgaagtggaagtcccagagagagcctggagctcaggctttgattgggtgacggatcattctggaaaaacagtttggtttgttccaagcgtgaggaacggcaatgagatcgcagcttgtctgacaaaggctggaaaacgggtcatacagctcagcagaaagacttttgagacagagttccagaaaacaaaacatcaagagtgggactttgtcgtgacaactgacatttcagagatgggcgccaactttaaagctgaccgtgtcatagattccaggagatgcctaaagccggtcatacttgatggcgagagagtcattctggctggacccatgcctgtcacacatgccagcgctgcccagaggagggggcgcataggcaggaatcccaacaaacctggagatgagtatctgtatggaggtgggtgcgcagagactgacgaagaccatgcacactggcttgaagcaagaatgctccttgacaatatttacctccaagatggcctcatagcctcgctctatcgacctgaggccgacaaagtagcagccattgagggagagttcaagcttaggacggagcaaaggaagacctttgtggaactcatgaaaagaggagatcttcctgtttggctggcctatcaggttgcatctgccggaataacctacacagatagaagatggtgctttgatggcacgaccaacaacaccataatggaagacagtgtgccggcagaggtgtggaccagacacggagagaaaagagtgctcaaaccgaggtggatggacgccagagtttgttcagatcatgcggccctgaagtcattcaaggagtttgccgctgggaaaagaggagcggcttttggagtgatggaagccctgggaacactgccaggacacatgacagagagattccaggaagccattgacaacctcgctgtgctcatgcgggcagagactggaagcaggccttacaaagccgcggcggcccaattgccggagaccctagagaccataatgcttttggggttgctgggaacagtctcgctgggaatcttcttcgtcttgatgaggaacaagggcatagggaagatgggctttggaatggtgactcttggggccagcgcatggctcatgtggctctcggaaattgagccagccagaattgcatgtgtcctcattgttgtgttcctattgctggtggtgctcatacctgagccagaaaagcaaagatctccccaggacaaccaaatggcaatcatcatcatggtagcagtaggtcttctgggcttgattaccgccaatgaactcggatggttggagagaacaaagagtgacctaagccatctaatgggaaggagagaggagggggcaaccataggattctcaatggacattgacctgcggccagcctcagcttgggccatctatgctgccttgacaactttcattaccccagccgtccaacatgcagtgaccacctcatacaacaactactccttaatggcgatggccacgcaagctggagtgttgtttggcatgggcaaagggatgccattctacgcatgggactttggagtcccgctgctaatgataggttgctactcacaattaacacccctgaccctaatagtggccatcattttgctcgtggcgcactacatgtacttgatcccagggctgcaggcagcagctgcgcgtgctgcccagaagagaacggcagctggcatcatgaagaaccctgttgtggatggaatagtggtgactgacattgacacaatgacaattgacccccaagtggagaaaaagatgggacaggtgctactcatagcagtagccgtctccagcgccatactgtcgcggaccgcctgggggtggggggaggctggggctctgatcacagccgcaacttccactttgtgggaaggctctccgaacaagtactggaactcctctacagccacttcactgtgtaacatttttaggggaagttacttggctggagcttctctaatctacacagtaacaagaaacgctggcttggtcaagagacgtgggggtggaacaggagagaccctgggagagaaatggaaggcccgcttgaaccagatgtcggccctggagttctactcctacaaaaagtcaggcatcaccgaggtgtgcagagaagaggcccgccgcgccctcaaggacggtgtggcaacgggaggccatgctgtgtcccgaggaagtgcaaagctgagatggttggtggagcggggatacctgcagccctatggaaaggtcattgatcttggatgtggcagagggggctggagttactacgtcgccaccatccgcaaagttcaagaagtgaaaggatacacaaaaggaggccctggtcatgaagaacccgtgttggtgcaaagctatgggtggaacatagtccgtcttaagagtggggtggacgtctttcatatggcggctgagccgtgtgacacgttgctgtgtgacataggtgagtcatcatctagtcctgaagtggaagaagcacggacgctcagagtcctctccatggtgggggattggcttgaaaaaagaccaggagccttttgtataaaagtgttgtgcccatacaccagcactatgatggaaaccctggagcgactgcagcgtaggtatgggggaggactggtcagagtgccactctcccgcaactctacacatgagatgtactgggtctctggagcgaaaagcaacaccataaaaagtgtgtccaccacgagccagctcctcttggggcgcatggacgggcctaggaggccagtgaaatatgaggaggatgtgaatctcggctctggcacgcgggctgtggtaagctgcgctgaagctcccaacatgaagatcattggtaaccgcattgaaaggatccgcagtgagcacgcggaaacgtggttctttgacgagaaccacccatataggacatgggcttaccatggaagctatgaggcccccacacaagggtcagcgtcctctctaataaacggggttgtcaggctcctgtcaaaaccctgggatgtggtgactggagtcacaggaatagccatgaccgacaccacaccgtatggtcagcaaagagttttcaaggaaaaagtggacactagggtgccagacccccaagaaggcactcgtcaggttatgagcatggtctcttcctggttgtggaaagagctaggcaaacacaaacggccacgagtctgcaccaaagaagagttcatcaacaaggttcgtagcaatgcagcattaggggcaatatttgaagaggaaaaagagtggaagactgcagtggaagctgtgaacgatccaaggttctgggctctagtggacaaggaaagagagcaccacctgagaggagagtgccagagctgtgtgtacaacatgatgggaaaaagagaaaagaaacaaggggaatttggaaaggccaagggcagccgcgccatctggtatatgtggctaggggctagatttctagagttcgaagcccttggattcttgaacgaggatcactggatggggagagagaactcaggaggtggtgttgaagggctgggattacaaagactcggatatgtcctagaagagatgagtcgtataccaggaggaaggatgtatgcagatgacactgctggctgggacacccgcattagcaggtttgatctggagaatgaagctctaatcaccaaccaaatggagaaagggcacagggccttggcattggccataatcaagtacacataccaaaacaaagtggtaaaggtccttagaccagctgaaaaagggaaaacagttatggacattatttcgagacaagaccaaagggggagcggacaagttgtcacttacgctcttaacacatttaccaacctagtggtgcaactcattcggaatatggaggctgaggaagttctagagatgcaagacttgtggctgctgcggaggtcagagaaagtgaccaactggttgcagagcaacggatgggataggctcaaacgaatggcagtcagtggagatgattgcgttgtgaagccaattgatgataggtttgcacatgccctcaggttcttgaatgatatgggaaaagttaggaaggacacacaagagtggaaaccctcaactggatgggacaactgggaagaagttccgttttgctcccaccacttcaacaagctccatctcaaggacgggaggtccattgtggttccctgccgccaccaagatgaactgattggccgggcccgcgtctctccaggggcgggatggagcatccgggagactgcttgcctagcaaaatcatatgcgcaaatgtggcagctcctttatttccacagaagggacctccgactgatggccaatgccatttgttcatctgtgccagttgactgggttccaactgggagaactacctggtcaatccatggaaagggagaatggatgaccactgaagacatgcttgtggtgtggaacagagtgtggattgaggagaacgaccacatggaagacaagaccccagttacgaaatggacagacattccctatttgggaaaaagggaagacttgtggtgtggatctctcatagggcacagaccgcgcaccacctgggctgagaacattaaaaacacagtcaacatggtgcgcaggatcataggtgatgaagaaaagtacatggactacctatccacccaagttcgctacttgggtgaagaagggtctacacctggagtgctgtaagcaccaatcttaatgttgtcaggcctgctagtcagccacagcttggggaaagctgtgcagcctgtgacccccccaggagaagctgggaaaccaagcctatagtcaggccgagaacgccatggcacggaagaagccatgctgcctgtgagcccctcagaggacactgagtcaaaaaaccccacgcgcttggaggcgcaggatgggaaaagaaggtggcgaccttccccacccttcaatctggggcctgaactggagatcagctgtggatctccagaagagggactagtggttagagga

SEQ ID NO: 6 - DNA, 10807 bp, Zika virus
  Genomic RNA, complete genome, strain: MR766-NIID
agttgttgatctgtgtgagtcagactgcgacagttcgagtctgaagcgagagctaacaacagtatcaacaggtttaatttggatttggaaacgagagtttctggtcatgaaaaacccaaagaagaaatccggaggattccggattgtcaatatgctaaaacgcggagtagcccgtgtaaaccccttgggaggtttgaagaggttgccagccggacttctgctgggtcatggacccatcagaatggttttggcgatactagcctttttgagatttacagcaatcaagccatcactgggccttatcaacagatggggttccgtggggaaaaaagaggctatggaaataataaagaagttcaagaaagatcttgctgccatgttgagaataatcaatgctaggaaagagaggaagagacgtggcgcagacaccagcatcggaatcattggcctcctgctgactacagccatggcagcagagatcactagacgcgggagtgcatactacatgtacttggataggagcgatgccgggaaggccatttcgtttgctaccacattgggagtgaacaagtgccacgtacagatcatggacctcgggcacatgtgtgacgccaccatgagttatgagtgccctatgctggatgagggagtggaaccagatgatgtcgattgctggtgcaacacgacatcaacttgggttgtgtacggaacctgtcatcacaaaaaaggtgaggcacggcgatctagaagagccgtgacgctcccttctcactctacaaggaagttgcaaacgcggtcgcagacctggttagaatcaagagaatacacgaagcacttgatcaaggttgaaaactggatattcaggaaccccgggtttgcgctagtggccgttgccattgcctggcttttgggaagctcgacgagccaaaaagtcatatacttggtcatgatactgctgattgccccggcatacagtatcaggtgcattggagtcagcaatagagacttcgtggagggcatgtcaggtgggacctgggttgatgttgtcttggaacatggaggctgcgttaccgtgatggcacaggacaagccaacagttgacatagagttggtcacgacgacggttagtaacatggccgaggtaagatcctattgctacgaggcatcgatatcggacatggcttcggacagtcgttgcccaacacaaggtgaagcctaccttgacaagcaatcagacactcaatatgtctgcaaaagaacattagtggacagaggttggggaaacggttgtggactttttggcaaagggagcttggtgacatgtgccaagtttacgtgttctaagaagatgaccgggaagagcattcaaccggaaaatctggagtatcggataatgctatcagtgcatggctcccagcatagcgggatgactgtcaatgatataggatatgaaactgacgaaaatagagcgaaagtcgaggttacgcctaattcaccaagagcggaagcaaccttgggaggctttggaagcttaggacttgactgtgaaccaaggacaggccttgacttttcagatctgtattacctgaccatgaacaataagcattggttggtgcacaaagagtggtttcatgacatcccattgccttggcatgctggggcagacactggaactccacactggaacaacaaagaggcattggtagaattcaaggatgcccacgccaagaggcaaaccgtcgtcgttctggggagccaggaaggagccgttcacacggctctcgctggagctctagaggctgagatggatggtgcaaagggaaagctgttctctggccatttgaaatgccgcctaaaaatggacaagcttagattgaagggcgtgtcatattccttgtgcactgcggcattcacattcaccaaggtcccagctgaaacactgcatggaacagtcacagtggaggtgcagtatgcagggacagatggaccctgcaagatcccagtccagatggcggtggacatgcagaccctgaccccagttggaaggctgataaccgccaaccccgtgattactgaaagcactgagaactcaaagatgatgttggagcttgacccaccatttggggattcttacattgtcataggagttggggacaagaaaatcacccaccactggcataggagtggtagcaccatcggaaaggcatttgaggccactgtgagaggcgccaagagaatggcagtcctgggggatacagcctgggacttcggatcagtcgggggtgtgttcaactcactgggtaagggcattcaccagatttttggagcagccttcaaatcactgtttggaggaatgtcctggttctcacagatcctcataggcacgctgctagtgtggttaggtttgaacacaaagaatggatctatctccctcacatgcttggccctggggggagtgatgatcttcctctccacggctgtttctgctgacgtggggtgctcagtggacttctcaaaaaaggaaacgagatgtggcacgggggtattcatctataatgatgttgaagcctggagggaccggtacaagtaccatcctgactccccccgcagattggcagcagcagtcaagcaggcctgggaagaggggatctgtgggatctcatccgtttcaagaatggaaaacatcatgtggaaatcagtagaaggggagctcaatgctatcctagaggagaatggagttcaactgacagttgttgtgggatctgtaaaaaaccccatgtggagaggtccacaaagattgccagtgcctgtgaatgagctgccccatggctggaaagcctgggggaaatcgtattttgttagggcggcaaagaccaacaacagttttgttgtcgacggtgacacactgaaggaatgtccgcttgagcacagagcatggaatagttttcttgtggaggatcacgggtttggagtcttccacaccagtgtctggcttaaggtcagagaagattactcattagaatgtgacccagccgtcataggaacagctgttaagggaagggaggccgcgcacagtgatctgggctattggattgaaagtgaaaagaatgacacatggaggctgaagagggcccacctgattgagatgaaaacatgtgaatggccaaagtctcacacattgtggacagatggagtagaagaaagtgatcttatcatacccaagtctttagctggtccactcagccaccacaacaccagagagggttacagaacccaagtgaaagggccatggcacagtgaagagcttgaaatccggtttgaggaatgtccaggcaccaaggtttacgtggaggagacatgcggaactagaggaccatctctgagatcaactactgcaagtggaagggtcattgaggaatggtgctgtagggaatgcacaatgcccccactatcgtttcgagcaaaagacggctgctggtatggaatggagataaggcccaggaaagaaccagagagcaacttagtgaggtcaatggtgacagcggggtcaaccgatcatatggaccacttctctcttggagtgcttgtgattctactcatggtgcaggaggggttgaagaagagaatgaccacaaagatcatcatgagcacatcaatggcagtgctggtagtcatgatcttgggaggattttcaatgagtgacctggccaagcttgtgatcctgatgggtgctactttcgcagaaatgaacactggaggagatgtagctcacttggcattggtagcggcatttaaagtcagaccagccttgctggtctccttcattttcagagccaattggacaccccgtgagagcatgctgctagccctggcttcgtgtcttctgcaaactgcgatctctgctcttgaaggtgacttgatggtcctcattaatggatttgctttggcctggttggcaattcgagcaatggccgtgccacgcactgacaacatcgctctaccaatcttggctgctctaacaccactagctcgaggcacactgctcgtggcatggagagcgggcctggctacttgtggagggatcatgctcctctccctgaaagggaaaggtagtgtgaagaagaacctgccatttgtcatggccctgggattgacagctgtgagggtagtagaccctattaatgtggtaggactactgttactcacaaggagtgggaagcggagctggccccctagtgaagttctcacagccgttggcctgatatgtgcactggccggagggtttgccaaggcagacattgagatggctggacccatggctgcagtaggcttgctaattgtcagctatgtggtctcgggaaagagtgtggacatgtacattgaaagagcaggtgacatcacatgggaaaaggacgcggaagtcactggaaacagtcctcggcttgacgtggcactggatgagagtggtgatttctccttggtagaggaagatggtccacccatgagagagatcatacttaaggtggtcctgatggccatctgtggcatgaacccaatagctataccttttgctgcaggagcgtggtatgtgtatgtgaagactgggaaaaggagtggcgccctctgggacgtgcctgctcccaaagaagtgaagaaaggagagaccacagatggagtgtacagagtgatgactcgcagactgctaggttcaacacaggttggagtgggagtcatgcaagagggagtcttccacaccatgtggcacgttacaaaaggagccgcactgaggagcggtgagggaagacttgatccatactggggggatgtcaagcaggacttggtgtcatactgtgggccttggaagttggatgcagcttgggatggactcagcgaggtacagcttttggccgtacctcccggagagagggccagaaacattcagaccctgcctggaatattcaagacaaaggacggggacatcggagcagttgctctggactaccctgcagggacctcaggatctccgatcctagacaaatgtggaagagtgataggactctatggcaatggggttgtgatcaagaatggaagctatgttagtgctataacccagggaaagagggaggaggagactccggttgaatgtttcgaaccctcgatgctgaagaagaagcagctaactgtcttggatctgcatccaggagccggaaaaaccaggagagttcttcctgaaatagtccgtgaagccataaaaaagagactccggacagtgatcttggcaccaactagggttgtcgctgctgagatggaggaggccttgagaggacttccggtgcgttacatgacaacagcagtcaacgtcacccattctgggacagaaatcgttgatttgatgtgccatgccactttcacttcacgcttactacaacccatcagagtccctaattacaatctctacatcatggatgaagcccacttcacagacccctcaagtatagctgcaagaggatatatatcaacaagggttgaaatgggcgaggcggctgccatttttatgactgccacaccaccaggaacccgtgatgcgtttcctgactctaactcaccaatcatggacacagaagtggaagtcccagagagagcctggagctcaggctttgattgggtgacagaccattctgggaaaacagtttggttcgttccaagcgtgagaaacggaaatgaaatcgcagcctgtctgacaaaggctggaaagcgggtcatacagctcagcaggaagacttttgagacagaatttcagaaaacaaaaaatcaagagtgggactttgtcataacaactgacatctcagagatgggcgccaacttcaaggctgaccgggtcatagactctaggagatgcctaaaaccagtcatacttgatggtgagagagtcatcttggctgggcccatgcctgtcacgcatgctagtgctgctcagaggagaggacgtataggcaggaaccctaacaaacctggagatgagtacatgtatggaggtgggtgtgcagagactgatgaaggccatgcacactggcttgaagcaagaatgcttcttgacaacatctacctccaggatggcctcatagcctcgctctatcggcctgaggccgataaggtagccgccattgagggagagtttaagctgaggacagagcaaaggaagaccttcgtggaactcatgaagagaggagaccttcccgtctggctagcctatcaggttgcatctgccggaataacttacacagacagaagatggtgctttgatggcacaaccaacaacaccataatggaagacagcgtaccagcagaggtgtggacaaagtatggagagaagagagtgctcaaaccgagatggatggatgctagggtctgttcagaccatgcggccctgaagtcgttcaaagaattcgccgctggaaaaagaggagcggctttgggagtaatggaggccctgggaacactgccaggacacatgacagagaggtttcaggaagccattgacaacctcgccgtgctcatgcgagcagagactggaagcaggccttataaggcagcggcagcccaactgccggagaccctagagaccattatgctcttaggtttgctgggaacagtttcactggggatcttcttcgtcttgatgcggaataagggcatcgggaagatgggctttggaatggtaacccttggggccagtgcatggctcatgtggctttcggaaattgaaccagccagaattgcatgtgtcctcattgttgtgtttttattactggtggtgctcatacccgagccagagaagcaaagatctccccaagataaccagatggcaattatcatcatggtggcagtgggccttctaggtttgataactgcaaacgaacttggatggctggaaagaacaaaaaatgacatagctcatctaatgggaaggagagaagaaggagcaaccatgggattctcaatggacattgatctgcggccagcctccgcctgggctatctatgccgcattgacaactctcatcaccccagctgtccaacatgcggtaaccacttcatacaacaactactccttaatggcgatggccacacaagctggagtgctgtttggcatgggcaaagggatgccattttatgcatgggaccttggagtcccgctgctaatgatgggttgctattcacaattaacacccctgactctgatagtagctatcattctgcttgtggcgcactacatgtacttgatcccaggcctacaagcggcagcagcgcgtgctgcccagaaaaggacagcagctggcatcatgaagaatcccgttgtggatggaatagtggtaactgacattgacacaatgacaatagacccccaggtggagaagaagatgggacaagtgttactcatagcagtagccatctccagtgctgtgctgctgcggaccgcctggggatggggggaggctggagctctgatcacagcagcgacctccaccttgtgggaaggctctccaaacaaatactggaactcctctacagccacctcactgtgcaacatcttcagaggaagctatctggcaggagcttcccttatctatacagtgacgagaaacgctggcctggttaagagacgtggaggtgggacgggagagactctgggagagaagtggaaagctcgtctgaatcagatgtcggccctggagttctactcttataaaaagtcaggtatcactgaagtgtgtagagaggaggctcgccgtgccctcaaggatggagtggccacaggaggacatgccgtatcccggggaagtgcaaagctcagatggttggtggagagaggatatctgcagccctatgggaaggttgttgacctcggatgtggcagagggggctggagctattatgccgccaccatccgcaaagtgcaggaggtgagaggatacacaaagggaggtcccggtcatgaagaacccatgctggtgcaaagctatgggtggaacatagttcgtctcaagagtggagtggacgtcttccacatggcggctgagccgtgtgacactctgctgtgtgacataggtgagtcatcatctagtcctgaagtggaagagacacgaacactcagagtgctctctatggtgggggactggcttgaaaaaagaccaggggccttctgtataaaggtgctgtgcccatacaccagcactatgatggaaaccatggagcgactgcaacgtaggcatgggggaggattagtcagagtgccattgtctcgcaactccacacatgagatgtactgggtctctggggcaaagagcaacatcataaaaagtgtgtccaccacaagtcagctcctcctgggacgcatggatggccccaggaggccagtgaaatatgaggaggatgtgaacctcggctcgggtacacgagctgtggcaagctgtgctgaggctcctaacatgaaaatcatcggcaggcgcattgagagaatccgcaatgaacatgcagaaacatggtttcttgatgaaaaccacccatacaggacatgggcctaccatgggagctacgaagcccccacgcaaggatcagcgtcttccctcgtgaacggggttgttagactcctgtcaaagccttgggacgtggtgactggagttacaggaatagccatgactgacaccacaccatacggccaacaaagagtcttcaaagaaaaagtggacaccagggtgccagatccccaagaaggcactcgccaggtaatgaacatagtctcttcctggctgtggaaggagctggggaaacgcaagcggccacgcgtctgcaccaaagaagagtttatcaacaaggtgcgcagcaatgcagcactgggagcaatatttgaagaggaaaaagaatggaagacggctgtggaagctgtgaatgatccaaggttttgggccctagtggatagggagagagaacaccacctgagaggagagtgtcacagctgtgtgtacaacatgatgggaaaaagagaaaagaagcaaggagagttcgggaaagcaaaaggtagccgcgccatctggtacatgtggttgggagccagattcttggagtttgaagcccttggattcttgaacgaggaccattggatgggaagagaaaactcaggaggtggagtcgaagggttaggattgcaaagacttggatacattctagaagaaatgaatcgggcaccaggaggaaagatgtacgcagatgacactgctggctgggacacccgcattagtaagtttgatctggagaatgaagctctgattaccaaccaaatggaggaagggcacagaactctggcgttggccgtgattaaatacacataccaaaacaaagtggtgaaggttctcagaccagctgaaggaggaaaaacagttatggacatcatttcaagacaagaccagagagggagtggacaagttgtcacttatgctctcaacacattcaccaacttggtggtgcagcttatccggaacatggaagctgaggaagtgttagagatgcaagacttatggttgttgaggaagccagagaaagtgaccagatggttgcagagcaatggatgggatagactcaaacgaatggcggtcagtggagatgactgcgttgtgaagccaatcgatgataggtttgcacatgccctcaggttcttgaatgacatgggaaaagttaggaaagacacacaggagtggaaaccctcgactggatggagcaattgggaagaagtcccgttctgctcccaccacttcaacaagctgtacctcaaggatgggagatccattgtggtcccttgccgccaccaagatgaactgattggccgagctcgcgtctcaccaggggcaggatggagcatccgggagactgcctgtcttgcaaaatcatatgcgcagatgtggcagctcctttatttccacagaagagaccttcgactgatggctaatgccatttgctcggctgtgccagttgactgggtaccaactgggagaaccacctggtcaatccatggaaagggagaatggatgaccactgaggacatgctcatggtgtggaatagagtgtggattgaggagaacgaccatatggaggacaagactcctgtaacaaaatggacagacattccctatctaggaaaaagggaggacttatggtgtggatcccttatagggcacagaccccgcaccacttgggctgaaaacatcaaagacacagtcaacatggtgcgcaggatcataggtgatgaagaaaagtacatggactatctatccacccaagtccgctacttgggtgaggaagggtccacacccggagtgttgtaagcaccaattttagtgttgtcaggcctgctagtcagccacagtttggggaaagctgtgcagcctgtaacccccccaggagaagctgggaaaccaagctcatagtcaggccgagaacgccatggcacggaagaagccatgctgcctgtgagcccctcagaggacactgagtcaaaaaaccccacgcgcttggaagcgcaggatgggaaaagaaggtggcgaccttccccacccttcaatctggggcctgaactggagactagctgtgaatctccagcagagggactagtggttagaggagaccccccggaaaacgcaaaacagcatattgacgctgggaaagaccagagactccatgagtttccaccacgctggccgccaggcacagatcgccgaacagcggcggccggtgtggggaaatccatggtttct

SEQ ID NO: 7 - DNA, 10794 bp, Zika virus
  NCBI Reference Sequence: NC_012532.1
agttgttgatctgtgtgagtcagactgcgacagttcgagtctgaagcgagagctaacaacagtatcaacaggtttaatttggatttggaaacgagagtttctggtcatgaaaaaccccaaagaagaaatccggaggatccggattgtcaatatgctaaaacgcggagtagcccgtgtaaaccccttgggaggtttgaagaggttgccagccggacttctgctgggtcatggacccatcagaatggttttggcgatactagcctttttgagatttacagcaatcaagccatcactgggccttatcaacagatggggttccgtggggaaaaaagaggctatggaaataataaagaagttcaagaaagatcttgctgccatgttgagaataatcaatgctaggaaagagaggaagagacgtggcgcagacaccagcatcggaatcattggcctcctgctgactacagccatggcagcagagatcactagacgcgggagtgcatactacatgtacttggataggagcgatgccgggaaggccatttcgtttgctaccacattgggagtgaacaagtgccacgtacagatcatggacctcgggcacatgtgtgacgccaccatgagttatgagtgccctatgctggatgagggagtggaaccagatgatgtcgattgctggtgcaacacgacatcaacttgggttgtgtacggaacctgtcatcacaaaaaaggtgaggcacggcgatctagaagagccgtgacgctcccttctcactctacaaggaagttgcaaacgcggtcgcagacctggttagaatcaagagaatacacgaagcacttgatcaaggttgaaaactggatattcaggaaccccgggtttgcgctagtggccgttgccattgcctggcttttgggaagctcgacgagccaaaaagtcatatacttggtcatgatactgctgattgccccggcatacagtatcaggtgcattggagtcagcaatagagacttcgtggagggcatgtcaggtgggacctgggttgatgttgtcttggaacatggaggctgcgttaccgtgatggcacaggacaagccaacagtcgacatagagttggtcacgacgacggttagtaacatggccgaggtaagatcctattgctacgaggcatcgatatcggacatggcttcggacagtcgttgcccaacacaaggtgaagcctaccttgacaagcaatcagacactcaatatgtctgcaaaagaacattagtggacagaggttggggaaacggttgtggactttttggcaaagggagcttggtgacatgtgccaagtttacgtgttctaagaagatgaccgggaagagcattcaaccggaaaatctggagtatcggataatgctatcagtgcatggctcccagcatagcgggatgattggatatgaaactgacgaagatagagcgaaagtcgaggttacgcctaattcaccaagagcggaagcaaccttgggaggctttggaagcttaggacttgactgtgaaccaaggacaggccttgacttttcagatctgtattacctgaccatgaacaataagcattggttggtgcacaaagagtggtttcatgacatcccattgccttggcatgctggggcagacaccggaactccacactggaacaacaaagaggcattggtagaattcaaggatgcccacgccaagaggcaaaccgtcgtcgttctggggagccaggaaggagccgttcacacggctctcgctggagctctagaggctgagatggatggtgcaaagggaaggctgttctctggccatttgaaatgccgcctaaaaatggacaagcttagattgaagggcgtgtcatattccttgtgcactgcggcattcacattcaccaaggtcccagctgaaacactgcatggaacagtcacagtggaggtgcagtatgcagggacagatggaccctgcaagatcccagtccagatggcggtggacatgcagaccctgaccccagttggaaggctgataaccgccaaccccgtgattactgaaagcactgagaactcaaagatgatgttggagcttgacccaccatttggggattcttacattgtcataggagttggggacaagaaaatcacccaccactggcataggagtggtagcaccatcggaaaggcatttgaggccactgtgagaggcgccaagagaatggcagtcctgggggatacagcctgggacttcggatcagtcgggggtgtgttcaactcactgggtaagggcattcaccagatttttggagcagccttcaaatcactgtttggaggaatgtcctggttctcacagatcctcataggcacgctgctagtgtggttaggtttgaacacaaagaatggatctatctccctcacatgcttggccctggggggagtgatgatcttcctctccacggctgtttctgctgacgtggggtgctcagtggacttctcaaaaaaggaaacgagatgtggcacgggggtattcatctataatgatgttgaagcctggagggaccggtacaagtaccatcctgactccccccgcagattggcagcagcagtcaagcaggcctgggaagaggggatctgtgggatctcatccgtttcaagaatggaaaacatcatgtggaaatcagtagaaggggagctcaatgctatcctagaggagaatggagttcaactgacagttgttgtgggatctgtaaaaaaccccatgtggagaggtccacaaagattgccagtgcctgtgaatgagctgccccatggctggaaagcctgggggaaatcgtattttgttagggcggcaaagaccaacaacagttttgttgtcgacggtgacacactgaaggaatgtccgcttgagcacagagcatggaatagttttcttgtggaggatcacgggtttggagtcttccacaccagtgtctggcttaaggtcagagaagattactcattagaatgtgacccagccgtcataggaacagctgttaagggaagggaggccgcgcacagtgatctgggctattggattgaaagtgaaaagaatgacacatggaggctgaagagggcccacctgattgagatgaaaacatgtgaatggccaaagtctcacacattgtggacagatggagtagaagaaagtgatcttatcatacccaagtctttagctggtccactcagccaccacaacaccagagagggttacagaacccaagtgaaagggccatggcacagtgaagagcttgaaatccggtttgaggaatgtccaggcaccaaggtttacgtggaggagacatgcggaactagaggaccatctctgagatcaactactgcaagtggaagggtcattgaggaatggtgctgtagggaatgcacaatgcccccactatcgtttcgagcaaaagacggctgctggtatggaatggagataaggcccaggaaagaaccagagagcaacttagtgaggtcaatggtgacagcggggtcaaccgatcatatggaccacttctctcttggagtgcttgtgattctactcatggtgcaggaggggttgaagaagagaatgaccacaaagatcatcatgagcacatcaatggcagtgctggtagtcatgatcttgggaggattttcaatgagtgacctggccaagcttgtgatcctgatgggtgctactttcgcagaaatgaacactggaggagatgtagctcacttggcattggtagcggcatttaaagtcagaccagccttgctggtctccttcattttcagagccaattggacaccccgtgagagcatgctgctagccctggcttcgtgtcttctgcaaactgcgatctctgctcttgaaggtgacttgatggtcctcattaatggatttgctttggcctggttggcaattcgagcaatggccgtgccacgcactgacaacatcgctctaccaatcttggctgctctaacaccactagctcgaggcacactgctcgtggcatggagagcgggcctggctacttgtggagggatcatgctcctctccctgaaagggaaaggtagtgtgaagaagaacctgccatttgtcatggccctgggattgacagctgtgagggtagtagaccctattaatgtggtaggactactgttactcacaaggagtgggaagcggagctggccccctagtgaagttctcacagccgttggcctgatatgtgcactggccggagggtttgccaaggcagacattgagatggctggacccatggctgcagtaggcttgctaattgtcagctatgtggtctcgggaaagagtgtggacatgtacattgaaagagcaggtgacatcacatgggaaaaggacgcggaagtcactggaaacagtcctcggcttgacgtggcactggatgagagtggtgacttctccttggtagaggaagatggtccacccatgagagagatcatactcaaggtggtcctgatggccatctgtggcatgaacccaatagctataccttttgctgcaggagcgtggtatgtgtatgtgaagactgggaaaaggagtggcgccctctgggacgtgcctgctcccaaagaagtgaagaaaggagagaccacagatggagtgtacagagtgatgactcgcagactgctaggttcaacacaggttggagtgggagtcatgcaagagggagtcttccacaccatgtggcacgttacaaaaggagccgcactgaggagcggtgagggaagacttgatccatactggggggatgtcaagcaggacttggtgtcatactgtgggccttggaagttggatgcagcttgggatggactcagcgaggtacagcttttggccgtacctcccggagagagggccagaaacattcagaccctgcctggaatattcaagacaaaggacggggacatcggagcagttgctctggactaccctgcagggacctcaggatctccgatcctagacaaatgtggaagagtgataggactctatggcaatggggttgtgatcaagaatggaagctatgttagtgctataacccagggaaagagggaggaggagactccggttgaatgtttcgaaccctcgatgctgaagaagaagcagctaactgtcttggatctgcatccaggagccggaaaaaccaggagagttcttcctgaaatagtccgtgaagccataaaaaagagactccggacagtgatcttggcaccaactagggttgtcgctgctgagatggaggaggccttgagaggacttccggtgcgttacatgacaacagcagtcaacgtcacccattctgggacagaaatcgttgatttgatgtgccatgccactttcacttcacgcttactacaacccatcagagtccctaattacaatctcaacatcatggatgaagcccacttcacagacccctcaagtatagctgcaagaggatacatatcaacaagggttgaaatgggcgaggcggctgccatttttatgactgccacaccaccaggaacccgtgatgcgtttcctgactctaactcaccaatcatggacacagaagtggaagtcccagagagagcctggagctcaggctttgattgggtgacagaccattctgggaaaacagtttggttcgttccaagcgtgagaaacggaaatgaaatcgcagcctgtctgacaaaggctggaaagcgggtcatacagctcagcaggaagacttttgagacagaatttcagaaaacaaaaaatcaagagtgggactttgtcataacaactgacatctcagagatgggcgccaacttcaaggctgaccgggtcatagactctaggagatgcctaaaaccagtcatacttgatggtgagagagtcatcttggctgggcccatgcctgtcacgcatgctagtgctgctcagaggagaggacgtataggcaggaaccctaacaaacctggagatgagtacatgtatggaggtgggtgtgcagagactgatgaaggccatgcacactggcttgaagcaagaatgcttcttgacaacatctacctccaggatggcctcatagcctcgctctatcggcctgaggccgataaggtagccgccattgagggagagtttaagctgaggacagagcaaaggaagaccttcgtggaactcatgaagagaggagaccttcccgtctggctagcctatcaggttgcatctgccggaataacttacacagacagaagatggtgctttgatggcacaaccaacaacaccataatggaagacagtgtaccagcagaggtttggacaaagtatggagagaagagagtgctcaaaccgagatggatggatgctagggtctgttcagaccatgcggccctgaagtcgttcaaagaattcgccgctggaaaaagaggagcggctttgggagtaatggaggccctgggaacactgccaggacacatgacagagaggtttcaggaagccattgacaacctcgccgtgctcatgcgagcagagactggaagcaggccttataaggcagcggcagcccaactgccggagaccctagagaccattatgctcttaggtttgctgggaacagtttcactggggatcttcttcgtcttgatgcggaataagggcatcgggaagatgggctttggaatggtaacccttggggccagtgcatggctcatgtggctttcggaaattgaaccagccagaattgcatgtgtcctcattgttgtgtttttattactggtggtgctcatacccgagccagagaagcaaagatctccccaagataaccagatggcaattatcatcatggtggcagtgggccttctaggtttgataactgcaaacgaacttggatggctggaaagaacaaaaaatgacatagctcatctaatgggaaggagagaagaaggagcaaccatgggattctcaatggacattgatctgcggccagcctccgcctgggctatctatgccgcattgacaactctcatcaccccagctgtccaacatgcggtaaccacttcatacaacaactactccttaatggcgatggccacacaagctggagtgctgtttggcatgggcaaagggatgccatttatgcatggggaccttggagtcccgctgctaatgatgggttgctattcacaattaacacccctgactctgatagtagctatcattctgcttgtggcgcactacatgtacttgatcccaggcctacaagcggcagcagcgcgtgctgcccagaaaaggacagcagctggcatcatgaagaatcccgttgtggatggaatagtggtaactgacattgacacaatgacaatagacccccaggtggagaagaagatgggacaagtgttactcatagcagtagccatctccagtgctgtgctgctgcggaccgcctggggatggggggaggctggagctctgatcacagcagcgacctccaccttgtgggaaggctctccaaacaaatactggaactcctctacagccacctcactgtgcaacatcttcagaggaagctatctggcaggagcttcccttatctatacagtgacgagaaacgctggcctggttaagagacgtggaggtgggacgggagagactctgggagagaagtggaaagctcgtctgaatcagatgtcggccctggagttctactcttataaaaagtcaggtatcactgaagtgtgtagagaggaggctcgccgtgccctcaaggatggagtggccacaggaggacatgccgtatcccggggaagtgcaaagatcagatggttggaggagagaggatatctgcagccctatgggaaggttgttgacctcggatgtggcagagggggctggagctattatgccgccaccatccgcaaagtgcaggaggtgagaggatacacaaagggaggtcccggtcatgaagaacccatgctggtgcaaagctatgggtggaacatagttcgtctcaagagtggagtggacgtcttccacatggcggctgagccgtgtgacactctgctgtgtgacataggtgagtcatcatctagtcctgaagtggaagagacacgaacactcagagtgctctctatggtgggggactggcttgaaaaaagaccaggggccttctgtataaaggtgctgtgcccatacaccagcactatgatggaaaccatggagcgactgcaacgtaggcatgggggaggattagtcagagtgccattgtgtcgcaactccacacatgagatgtactgggtctctggggcaaagagcaacatcataaaaagtgtgtccaccacaagtcagctcctcctgggacgcatggatggccccaggaggccagtgaaatatgaggaggatgtgaacctcggctcgggtacacgagctgtggcaagctgtgctgaggctcctaacatgaaaatcatcggcaggcgcattgagagaatccgcaatgaacatgcagaaacatggtttcttgatgaaaaccacccatacaggacatgggcctaccatgggagctacgaagcccccacgcaaggatcagcgtcttccctcgtgaacggggttgttagactcctgtcaaagccttgggacgtggtgactggagttacaggaatagccatgactgacaccacaccatacggccaacaaagagtcttcaaagaaaaagtggacaccagggtgccagatccccaagaaggcactcgccaggtaatgaacatagtctcttcctggctgtggaaggagctggggaaacgcaagcggccacgcgtctgcaccaaagaagagtttatcaacaaggtgcgcagcaatgcagcactgggagcaatatttgaagaggaaaaagaatggaagacggctgtggaagctgtgaatgatccaaggttttgggccctagtggatagggagagagaacaccacctgagaggagagtgtcacagctgtgtgtacaacatgatgggaaaaagagaaaagaagcaaggagagttcgggaaagcaaaaggtagccgcgccatctggtacatgtggttgggagccagattcttggagtttgaagcccttggattcttgaacgaggaccattggatgggaagagaaaactcaggaggtggagtcgaagggttaggattgcaaagacttggatacattctagaagaaatgaatcgggcaccaggaggaaagatgtacgcagatgacactgctggctgggacacccgcattagtaagtttgatctggagaatgaagctctgattaccaaccaaatggaggaagggcacagaactctggcgttggccgtgattaaatacacataccaaaacaaagtggtgaaggttctcagaccagctgaaggaggaaaaacagttatggacatcatttcaagacaagaccagagagggagtggacaagttgtcacttatgctctcaacacattcaccaacttggtggtgcagcttatccggaacatggaagctgaggaagtgttagagatgcaagacttatggttgttgaggaagccagagaaagtgaccagatggttgcagagcaatggatgggatagactcaaacgaatggcggtcagtggagatgactgcgttgtgaagccaatcgatgataggtttgcacatgccctcaggttcttgaatgacatgggaaaagttaggaaagacacacaggagtggaaaccctcgactggatggagcaattgggaagaagtcccgttctgctcccaccacttcaacaagctgtacctcaaggatgggagatccattgtggtcccttgccgccaccaagatgaactgattggccgagctcgcgtctcaccaggggcaggatggagcatccgggagactgcctgtcttgcaaaatcatatgcgcagatgtggcagctcctttatttccacagaagagaccttcgactgatggctaatgccatttgctcggctgtgccagttgactgggtaccaactgggagaaccacctggtcaatccatggaaagggagaatggatgaccactgaggacatgctcatggtgtggaatagagtgtggattgaggagaacgaccatatggaggacaagactcctgtaacaaaatggacagacattccctatctaggaaaaagggaggacttatggtgtggatcccttatagggcacagaccccgcaccacttgggctgaaaacatcaaagacacagtcaacatggtgcgcaggatcataggtgatgaagaaaagtacatggactatctatccacccaagtccgctacttgggtgaggaagggtccacacccggagtgttgtaagcaccaattttagtgttgtcaggcctgctagtcagccacagtttggggaaagctgtgcagcctgtaacccccccaggagaagctgggaaaccaagctcatagtcaggccgagaacgccatggcacggaagaagccatgctgcctgtgagcccctcagaggacactgagtcaaaaaaccccacgcgcttggaagcgcaggatgggaaaagaaggtggcgaccttccccacccttcaatctggggcctgaactggagactagctgtgaatctccagcagagggactagtggttagaggagaccccccggaaaacgcaaaacagcatattgacgtgggaaagaccagagactccatgagtttccaccacgctggccgccaggcacagatcgccgaacttcggcggccggtgtggggaaatccatggtttct

SEQ ID NO: 8 - DNA, 10676 bp, Zika virus
  Strain ZikaSPH2015
gttgttactgttgctgactcagactgcgacagttcgagtttgaagcgaaagctagcaacagtatcaacaggttttatttggatttggaaacgagagtttctggtcatgaaaaacccaaaaaagaaatccggaggattccggattgtcaatatgctaaaacgcggagtagcccgtgtgagcccctttgggggcttgaagaggctgccagccggacttctgctgggtcatgggcccatcaggatggtcttggcaattctagcctttttgagattcacggcaatcaagccatcactgggtctcatcaatagatggggttcagtggggaaaaaagaggctatggaaataataaagaagttcaagaaagatctggctgccatgctgagaataatcaatgctaggaaggagaagaagagacggggcgcagatactagtgtcggaattgttggcctcctgctgaccacagctatggcagcggaggtcactagacgtgggagtgcatactatatgtacttggacagaaacgatgctggggaggccatatcttttccaaccacattggggatgaataagtgttatatacagatcatggatcttggacacatgtgtgatgccaccatgagctatgaatgccctatgctggatgagggggtggaaccagatgacgtcgattgttggtgcaacacgacgtcaacttgggttgtgtacggaacctgccatcacaaaaaaggtgaagcacggagatctagaagagctgtgacgctcccctcccattccactaggaagctgcaaacgcggtcgcaaacctggttggaatcaagagaatacacaaagcacttgattagagtcgaaaattggatattcaggaaccctggcttcgcgttagcagcagctgccatcgcttggcttttgggaagctcaacgagccaaaaagtcatatacttggtcatgatactgctgattgccccggcatacagcatcaggtgcataggagtcagcaatagggactttgtggaaggtatgtcaggtgggacttgggttgatattgtcttggaacatggaggttgtgtcaccgtaatggcacaggacaaaccgactgtcgacatagagctggttacaacaacagtcagcaacatggcggaggtaagatcctactgctatgaggcatcaatatcagacatggcttcggacagccgctgcccaacacaaggtgaagcctaccttgacaagcaatcagacactcaatatgtctgcaaaagaacgttagtggacagaggctggggaaatggatgtggactttttggcaaagggagtctggtgacatgcgctaagtttgcatgctccaagaaaatgaccgggaagagcatccagccagagaatctggagtaccggataatgctgtcagttcatggctcccagcacagtgggatgatcgttaatgacacaggacatgaaactgatgagaatagagcgaaggttgagataacgcccaattcaccaagagccgaagccaccctggggggttttggaagcctaggacttgattgtgaaccgaggacaggccttgacttttcagatttgtattacttgactatgaataacaagcactggttggttcacaaggagtggttccacgacattccattaccttggcacgctggggcagacaccggaactccacactggaacaacaaagaagcactggtagagttcaaggacgcacatgccaaaaggcaaactgtcgtggttctagggagtcaagaaggagcagttcacacggcccttgctggagctctggaggctgagatggatggtgcaaagggaaggctgtcctctggccacttgaaatgtcgcctgaaaatggataaacttagattgaagggcgtgtcatactccttgtgtaccgcagcgttcacattcaccaagatcccggctgaaacactgcacgggacagtcacagtggaggtacagtacgcagggacagatggaccttgcaaggttccagctcagatggcggtggacatgcaaactctgaccccagttgggaggttgataaccgctaaccccgtaatcactgaaagcactgagaactctaagatgatgctggaacttgatccaccatttggggactcttacattgtcataggagtcggggagaagaagatcacccaccactggcacaggagtggcagcaccattggaaaagcatttgaagccactgtgagaggtgccaagagaatggcagtcttgggagacacagcctgggactttggatcagttggaggcgctctcaactcattgggcaagggcatccatcaaatttttggagcagctttcaaatcattgtttggaggaatgtcctggttctcacaaattctcattggaacgttgctgatgtggttgggtctgaacacaaagaatggatctatttcccttatgtgcttggccttagggggagtgttgatcttcttatccacagccgtctctgctgatgtggggtgctcggtggacttctcaaagaaggagacgagatgcggtacaggggtgttcgtctataacgacgttgaagcctggagggacaggtacaagtaccatcctgactccccccgtagattggcagcagcagtcaagcaagcctgggaagatggtatctgcgggatctcctctgtttcaagaatggaaaacatcatgtggagatcagtagaaggggagctcaacgcaatcctggaagagaatggagttcaactgacggtcgttgtgggatctgtaaaaaaccccatgtggagaggtccacagagattgcccgtgcctgtgaacgagctgccccacggctggaaggcttgggggaaatcgcacttcgtcagagcagcaaagacaaataacagctttgtcgtggatggtgacacactgaaggaatgcccactcaaacatagagcatggaacagctttcttgtggaggatcatgggttcggggtatttcacactagtgtctggctcaaggttagagaagattattcattagagtgtgatccagccgttattggaacagctgttaagggaaaggaggctgtacacagtgatctaggctactggattgagagtgagaagaatgacacatggaggctgaagagggcccatctgatcgagatgaaaacatgtgaatggccaaagtcccacacattgtggacagatggaatagaagagagtgatctgatcatacccaagtctttagctgggccactcagccatcacaataccagagagggctacaggacccaaatgaaagggccatggcacagtgaagagcttgaaattcggtttgaggaatgcccaggcactaaggtccacgtggaggaaacatgtggaacaagaggaccatctctgagatcaaccactgcaagcggaagggtgatcgaggaatggtgctgcagggagtgcacaatgcccccactgtcgttccgggctaaagatggctgttggtatggaatggagataaggcccaggaaagaaccagaaagcaacttagtaaggtcaatggtgactgcaggatcaactgatcacatggatcacttctcccttggagtgcttgtgattctgctcatggtgcaggaagggctgaagaagagaatgaccacaaagatcatcataagcacatcaatggcagtgctggtagctatgatcctgggaggattttcaatgagtgacctggctaagcttgcaattttgatgggtgccaccttcgcggaaatgaacactggaggagatgtagctcatctggcgctgatagcggcattcaaagtcagaccagcgttgctggtatctttcatcttcagagctaattggacaccccgtgaaagcatgctgctggccttggcctcgtgtcttttgcaaactgcgatctccgccttggaaggcgacctgatggttctcatcaatggttttgctttggcctggttggcaatacgagcgatggttgttccacgcactgataacatcaccttggcaatcctggctgctctgacaccactggcccggggcacactgcttgtggcgtggagagcaggccttgctacttgcggggggtttatgctcctctctctgaagggaaaaggcagtgtgaagaagaacttaccatttgtcatggccctgggactaaccgctgtgaggctggtcgaccccatcaacgtggtggggctgctgttgctcacaaggagtgggaagcggagctggccccctagcgaagtactcacagctgttggcctgatatgcgcattggctggagggttcgccaaggcagatatagagatggctgggcccatggccgcggtcggtctgctaattgtcagttacgtggtctcaggaaagagtgtggacatgtacattgaaagagcaggtgacatcacatgggaaaaagatgcggaagtcactggaaacagtccccggctcgatgtggcgctagatgagagtggtgatttctccctggtggaggatgacggtccccccatgagagagatcatactcaaggtggtcctgatgaccatctgtggcatgaacccaatagccataccctttgcagctggagcgtggtacgtatacgtgaagactggaaaaaggagtggtgctctatgggatgtgcctgctcccaaggaagtaaaaaagggggagaccacagatggagtgtacagagtaatgactcgtagactgctaggttcaacacaagttggagtgggagttatgcaagagggggtctttcacactatgtggcacgtcacaaaaggatccgcgctgagaagcggtgaagggagacttgatccatactggggagatgtcaagcaggatctggtgtcatactgtggtccatggaagctagatgccgcctgggacgggcacagcgaggtgcagctcttggccgtgccccccggagagagagcgaggaacatccagactctgcccggaatatttaagacaaaggatggggacattggagcggttgcgctggattacccagcaggaacttcaggatctccaatcctagacaagtgtgggagagtgataggactttatggcaatggggtcgtgatcaaaaatgggagttatgttagtgccatcacccaagggaggagggaggaagagactcctgttgagtgcttcgagccttcgatgctgaagaagaagcagctaactgtcttagacttgcatcctggagctgggaaaaccaggagagttcttcctgaaatagtccgtgaagccataaaaacaagactccgtactgtgatcttagctccaaccagggttgtcgctgctgaaatggaggaagcccttagagggcttccagtgcgttatatgacaacagcagtcaatgtcacccactctggaacagaaatcgtcgacttaatgtgccatgccaccttcacttcacgtctactacagccaatcagagtccccaactataatctgtatattatggatgaggcccacttcacagatccctcaagtatagcagcaagaggatacatttcaacaagggttgagatgggcgaggcggctgccatcttcatgaccgccacgccaccaggaacccgtgacgcatttccggactccaactcaccaattatggacaccgaagtggaagtcccagagagagcctggagctcaggctttgattgggtgacggattattctggaaaaacagtttggtttgttccaagcgtgaggaacggcaatgagatcgcagcttgtctgacaaaggctggaaaacgggtcatacagctcagcagaaagacttttgagacagagttccagaaaacaaaacatcaagagtgggactttgtcgtgacaactgacatttcagagatgggcgccaactttaaagctgaccgtgtcatagattccaggagatgcctaaagccggtcatacttgatggcgagagagtcattctggctggacccatgcctgtcacacatgccagcgctgcccagaggagggggcgcataggcaggaatcccaacaaacctggagatgagtatctgtatggaggtgggtgcgcagagactgacgaagaccatgcacactggcttgaagcaagaatgctccttgacaatatttacctccaagatggcctcatagcctcgctctatcgacctgaggccgacaaagtagcagccattgagggagagttcaagcttaggacggagcaaaggaagacctttgtggaactcatgaaaagaggagatcttcctgtttggctggcctatcaggttgcatctgccggaataacctacacagatagaagatggtgctttgatggcacgaccaacaacaccataatggaagacagtgtgccggcagaggtgtggaccagacacggagagaaaagagtgctcaaaccgaggtggatggacgccagagtttgttcagatcatgcggccctgaagtcattcaaggagtttgccgctgggaaaagaggagcggcttttggagtgatggaagccctgggaacactgccaggacacatgacagagagattccaggaagccattgacaacctcgctgtgctcatgcgggcagagactggaagcaggccttacaaagccgcggcggcccaattgccggagaccctagagaccattatgcttttggggttgctgggaacagtctcgctgggaatctttttcgtcttgatgaggaacaagggcatagggaagatgggctttggaatggtgactcttggggccagcgcatggctcatgtggctctcggaaattgagccagccagaattgcatgtgtcctcattgttgtgttcctattgctggtggtgctcatacctgagccagaaaagcaaagatctccccaggacaaccaaatggcaatcatcatcatggtagcagtaggtcttctgggcttgattaccgccaatgaactcggatggttggagagaacaaagagtgacctaagccatctaatgggaaggagagaggagggggcaaccatgggattctcaatggacattgacctgcggccagcctcagcttgggccatctatgctgccttgacaactttcattaccccagccgtccaacatgcagtgaccacttcatacaacaactactccttaatggcgatggccacgcaagctggagtgttgtttggtatgggcaaagggatgccattctacgcatgggactttggagtcccgctgctaatgataggttgctactcacaattaacgcccctgaccctaatagtggccatcattttgctcgtggcgcactacatgtacttgatcccagggctgcaggcagcagctgcgcgtgctgcccagaagagaacggcagctggcatcatgaagaaccctgttgtggatggaatagtggtgactgacattgacacaatgacaattgacccccaagtggagaaaaagatgggacaggtgctactcatggcagtagccgtctccagcgccatactgtcgcggaccgcctgggggtggggggaggctggggccctgatcacagccgcaacttccactttgtgggaaggctctccgaacaagtactggaactcctctacagccacttcactgtgtaacatttttaggggaagttacttggctggagcttctctaatctacacagtaacaagaaacgctggcttggtcaagagacgtgggggtggaacaggagagaccctgggagagaaatggaaggcccgcttgaaccagatgtcggccctggagttctactcctacaaaaagtcaggcatcaccgaggtgtgcagagaagaggcccgccgcgccctcaaggacggtgtggcaacgggaggccatgctgtgtcccgaggaagtgcaaagctgagatggttggtggagcggggatacctgcagccctatggaaaggtcattgatcttggatgtggcagagggggctggagttactacgccgccaccatccgcaaagttcaagaagtgaaaggatacacaaaaggaggccctggtcatgaagaacccgtgttggtgcaaagctatgggtggaacatagtccgtcttaagagtggggtggacgtctttcatatggcggctgagccgtgtgacacgttgctgtgtgacataggtgagtcatcatctagtcctgaagtggaagaagcacggacgctcagagtcctctccatggtgggggattggcttgaaaaaagaccaggagccttttgtataaaagtgttgtgcccatacaccagcactatgatggaaaccctggagcgactgcagcgtaggtatgggggaggactggtcagagtgccactctcccgcaactctacacatgagatgtactgggtctctggagcgaaaagcaacaccataaaaagtgtgtccaccacgagccagctcctcttggggcgcatggacgggcctaggaggccagtgaaatatgaggaggatgtgaatctcggctctggcacgcgggctgtggtaagctgcgctgaagctcccaacatgaagatcattggtaaccgcattgaaaggatccgcagtgagcacgcggaaacgtggttctttgacgagaaccacccatataggacatgggcttaccatggaagctatgaggcccccacacaagggtcagcgtcctctctaataaacggggttgtcaggctcctgtcaaaaccctgggatgtggtgactggagtcacaggaatagccatgaccgacaccacaccgtatggtcagcaaagagttttcaaggaaaaagtggacactagggtgccagacccccaagaaggtactcgtcaggttatgagcatggtctcttcctggttgtggaaagagctaggcaaacacaaacggccacgagtctgtaccaaagaagagttcatcaacaaggttcgtagcaatgcagcattaggggcaatatttgaagaggaaaaagagtggaagactgcagtggaagctgtgaacgatccaaggttctgggctctagtggacaaggaaagagagcaccacctgagaggagagtgccagagttgtgtgtacaacatgatgggaaaaagagaaaagaaacaaggggaatttggaaaggccaagggcagccgcgccatctggtatatgtggctaggggctagatttctagagttcgaagcccttggattcttgaacgaggatcactggatggggagagagaactcaggaggtggtgttgaagggctgggattacaaagactcggatatgtcctagaagagatgagtcgcataccaggaggaaggatgtatgcagatgacactgctggctgggacacccgcatcagcaggtttgatctggagaatgaagctctaatcaccaaccaaatggagaaagggcacagggccttggcattggccataatcaagtacacataccaaaacaaagtggtaaaggtccttagaccagctgaaaaagggaaaacagttatggacattatttcgagacaagaccaaagggggagcggacaagttgtcacttacgctcttaacacatttaccaacctagtggtgcaactcattcggaatatggaggctgaggaagtcctagagatgcaagacttgtggctgctgcggaggtcagagaaagtgaccaactggttgcagagcaacggatgggataggctcaaacgaatggcagtcagtggagatgattgcgttgtgaagccaattgatgataggtttgcacatgccctcaggttcttgaatgatatgggaaaagttaggaaggacacacaagagtggaaaccctcaactggatgggacaactgggaagaagttccgttttgctcccaccacttcaacaagctccatctcaaggacgggaggtccattgtggttccctgccgccaccaagatgaactgattggccgggcccgcgtctctccaggggcgggatggagcatccgggagactgcttgcctagcaaaatcatatgcgcaaatgtggcagctcctttatttccacagaagggacctccgactgatggccaatgccatttgttcatctgtgccagttgactgggttccaactgggagaactacctggtcaatccatggaaagggagaatggatgaccactgaagacatgcttgtggtgtggaacagagtgtggattgaggagaacgaccacatggaagacaagaccccagttacgaaatggacagacattccctatttgggaaaaagggaagacttgtggtgtggatctctcatagggcacagaccgcgcaccacctgggctgagaacattaaaaacacagtcaacatggtgcgcaggatcataggtgatgaagaaaagtacatggactacctatccacccaagttcgctacttgggtgaagaagggtctacacctggagtgctgtaagcaccaatcttaatgttgtcaggcctgctagtcagccacagcttggggaaagctgtgcagcctgtgacccccccaggagaagctgggaaaccaagcctatagtcaggccgagaacgccatggcacggaagaagccatgctgcctgtgagcccctcagaggacactgagtcaaaaaaccccacgcgcttggaggcgcaggatgggaaaagaaggtggcgaccttccccacccttcaatctggggcctgaactggagatcagctgtggatctccagaagagggactagtggttagaggaga

SEQ ID NO: 9 - DNA, 10794 bp, Zika virus; identical to SEQ ID NO: 7
  Strain MR 766

SEQ ID NO: 10 - DNA, 10662 bp, Zika virus
  Strain BeH815744 polyprotein gene
gtgaatcagactgcgacagttcgagtttgaagcgaaagctagcaacagtatcaacaggttttattttggatttggaaacgagagtttctggtcatgaaaaacccaaaaaagaaatccggaggattccggattgtcaatatgctaaaacgcggagtagcccgtgtgagcccctttgggggcttgaagaggctgccagccggacttctgctgggtcatgggcccatcaggatggtcttggcgattctagcctttttgagattcacggcaatcaagccatcactgggtctcatcaatagatggggttcagtggggaaaaaagaggctatggaaataataaagaagttcaagaaagatctggctgccatgctgagaataatcaatgctaggaaggagaagaagagacgaggcgcagatactagtgtcggaattgttggcctcctgctgaccacagctatggcagcggaggtcactagacgtgggagtgcatactatatgtacttggacagaaacgatgctggggaggccatatcttttccaaccacattggggatgaataagtgttatatacagatcatggatcttggacacatgtgtgatgccaccatgagctatgaatgccctatgctggatgagggggtggaaccagatgacgtcgattgttggtgcaacacgacgtcaacttgggttgtgtacggaacctgccatcacaaaaaaggtgaagcacggagatctagaagagctgtgacgctcccctcccattccactaggaagctgcaaacgcggtcgcaaacctggttggaatcaagagaatacacaaagcacttgattagagtcgaaaattggatatttaggaaccctggcttcgcgttagcagcagctgccatcgcttggcttttgggaagctcaacgagccaaaaagtcatatacttggtcatgatactgctgattgccccggcatacagcatcaggtgcataggagtcagcaatagggactttgtggaaggtatgtcaggtgggacctgggttgatgttgtcttggaacatggaggttgtgtcaccgtaatggcacaggacaaaccgactgtcgacatagagctggttacaacaacagtcagcaacatggcggaggtaagatcctactgctatgaggcatcaatatcagacatggcttcggacagccgctgcccaacacaaggtgaagcctaccttgacaagcaatcagacactcaatatgtctgcaaaagaacgttagtggacagaggctggggaaatggatgtggactttttggcaaagggagcctggtgacatgcgctaagtttgcatgctccaagaaaatgaccgggaagagcatccagccagagaatctggagtaccggataatgctgtcagttcatggctcccagcacagtgggatgattgttaatgacacaggacatgaaactgatgagaatagagcgaaagttgagataacgcccaattcaccaagagccgaagccaccctggggggttttggaagcctaggacttgattgtgaaccgaggacaggccttgacttttcagatttgtattacttgactatgaataacaagcactggttggttcacaaggagtggttccacgacattccattaccttggcacgctggggcagacaccggaactccacactggaacaacaaagaagcactggtagagttcaaggacgcacatgccaaaaggcaaactgtcgtggttctagggagtcaagaaggagcagttcacacggcccttgctggagctctggaggctgagatggatggtgcaaagggaaggctgtcctctggccacttgaaatgtcgcctgaaaatggataaacttagattgaagggcgtgtcatactccttgtgtactgcagcgttcacattcaccaagatcccggctgaaacactgcacgggacagtcacagtggaggtacagtacgcagggacagatggaccttgcaaggttccagctcagatggcggtggacatgcaaactctgaccccagttgggaggttgataaccgctaaccccgtaatcactgaaagcactgagaactctaagatgatgctggaacttgatccaccatttggggactcttacattgtcataggagtcggggagaagaagatcacccaccactggcacaggagtggcagcaccattggaaaagcatttgaagccactgtgagaggtgccaagagaatggcagtcttgggagacacagcctgggactttggatcagttggaggcgctctcaactcattgggcaagggcatccatcaaatttttggagcagctttcaaatcattgtttggaggaatgtcctggttctcacaaattctcattggaacgttgctgatgtggttgggtctgaacacaaagaatggatctatttcccttatgtgcttggccttagggggagtgttgatcttcttatccacagccgtctctgctgatgtggggtgctcggtggacttctcaaagaaggagacgagatgcggtacaggggtgttcgtctataacgacgttgaagcctggagggacaggtacaagtaccatcctgactccccccgtagattggcagcagcagtcaagcaagcctgggaagatggtatctgcgggatctcctctgtttcaagaatggaaaacatcatgtggagatcagtagaaggggagctcaacgcaatcctggaagagaatggagttcaactgacggtcgttgtgggatctgtaaaaaaccccatgtggagaggtccacagagattgcccgtgcctgtgaacgagctgccccacggctggaaggcttgggggaaatcgtacttcgtcagagcagcaaagacaaataacagctttgtcgtggatggtgacacactgaaggaatgcccactcaaacatagagcatggaacagctttcttgtggaggatcatgggttcggggtatttcacactagtgtctggctcaaggttagagaagattattcattagagtgtgatccagccgttattggaacagctgttaagggaaaggaggctgtacacagtgatctaggctactggattgagagtgagaagaatgacacatggaggctgaagagggcccatctgatcgagatgaaaacatgtgaatggccaaagtcccacacattgtggacagatggaatagaagagagtgatctgatcatacccaagtctttagctgggccactcagccatcacaataccagagagggctacaggacccaaatgaaagggccatggcacagtgaagagcttgaaattcggtttgaggaatgcccaggcactaaggtccacgtggaggaaacatgtggaacaagaggaccatctctgagatcaaccactgcaagcggaagggtgatcgaggaatggtgctgcagggagtgcacaatgcccccactgtcgttccgggctaaagatggctgttggtatggaatggagataaggcccaggaaagaaccagaaagcaacttagtaaggtcaatggtgactgcaggatcaactgatcacatggaccacttctcccttggagtgcttgtgattctgctcatggtgcaggaagggctgaagaagagaatgaccacaaagatcatcataagcacatcaatggcagtgctggtagctatgatcctgggaggattttcaatgagtgacctggctaagcttgcaattttgatgggtgccaccttcgcggaaatgaacactggaggagatgtagctcatctggcgctgatagcggcattcaaagtcagaccagcgttgctggtatctttcatcttcagagctaattggacaccccgtgaaagcatgctgctggccttggcctcgtgtcttttgcaaactgcgatctccgccttggaaggcgacctgatggttctcatcaatggttttgctttggcctggttggcaatacgagcgatggttgttccacgcactgataacatcaccttggcaatcctggctgctctgacaccactggcccggggcacactgcttgtggcgtggagagcaggccttgctacttgcggggggtttatgctcctctctctgaagggaaaaggcagtgtgaagaagaacttaccatttgtcatggccctgggactaaccgctgtgaggctggtcgaccccatcaacgtggtgggactgctgttgctcacaaggagtgggaagcggagctggccccctagcgaagtactcacagctgttggcctgatatgcgcattggctggagggttcgccaaggcagatatagagatggctgggcccatggccgcggtcggtctgctaattgtcagttacgtggtctcaggaaagagtgtggacatgtacattgaaagagcaggtgacatcacatgggaaaaagatgcggaagtcactggaaacagtccccggctcgatgtggcgctagatgagagtggtgatttctccctggtggaggatgacggtccccccatgagagagatcatactcaaggtggtcctgatgaccatctgtggcatgaacccaatagccataccctttgcagctggagcgtggtacgtatacgtgaagactggaaaaaggagtggtgctctatgggatgtgcctgctcccaaggaagtaaaaaagggggagaccacagatggagtgtacagagtaatgactcgtagactgctaggttcaacacaagttggagtgggagttatgcaagagggggtctttcacactatgtggcacgtcacaaaaggatccgcgctgagaagcggtgaagggagacttgatccatactggggagatgtcaagcaggatctggtgtcatactgtggtccatggaagctagatgccgcctgggacgggcacagcgaggtgcagctcttggccgtgccccccggagagagagcgaggaacatccagactctgcccggaatatttaagacaaaggatggggacattggagcggttgcgctggattacccagcaggaacttcaggatctccaatcctagacaagtgtgggagagtgataggactttatggcaatggggtcgtgatcaaaaatgggagttatgttagtgccatcacccaagggaggagggaggaagagactcctgttgagtgcttcgagccttcgatgctgaagaagaagcagctaactgtcttagacttgcatcctggagctgggaaaaccaggagagttcttcctgaaatagtccgtgaagccataaaaacaagactccgcaccgtgatcttagctccaaccagggttgtcgctgctgaaatggaggaggcccttagagggcttccagtgcgttatatgacaacagcagtcaatgtcacccactctggaacagaaatcgtcgacttaatgtgccatgccaccttcacttcacgtctactacagccaatcagagtccccaactataatctgtatattatggatgaggcccacttcacagatccctcaagtatagcagcaagaggatacatttcaacaagggttgagatgggcgaggcggctgccatcttcatgaccgccacgccaccaggaacccgtgacgcatttccggactccaactcaccaattatggacaccgaagtggaagtcccagagagagcctggagctcaggctttgattgggtgacggatcattctggaaaaacagtttggtttgttccaagcgtgaggaacggcaatgagatcgcagcttgtctgacaaaggctggaaaacgggtcatacagctcagcagaaagacttttgagacagagttccagaaaacaaaacatcaagagtgggactttgtcgtgacaactgacatttcagagatgggcgccaactttaaagctgaccgtgtcatagattccaggagatgcctaaagccggtcatacttgatggcgagagagtcattctggctggacccatgcctgtcacacatgccagcgctgcccagaggagggggcgcataggcaggaatcccaacaaacctggagatgagtatctgtatggaggtgggtgcgcagagactgacgaagaccatgcacactggcttgaagcaagaatgctccttgacaatatttacctccaagatggcctcatagcctcgctctatcgacctgaggccgacaaagtagcagccattgagggagagttcaagcttaggacggagcaaaggaagacctttgtggaactcatgaaaagaggagatcttcctgtttggctggcctatcaggttgcatctgccggaataacctacacagatagaagatggtgctttgatggcacgaccaacaacaccataatggaagacagtgtgccggcagaggtgtggaccagacacggagagaaaagagtgctcaaaccgaggtggatggacgccagagtttgttcagatcatgcggccctgaagtcattcaaggagtttgccgctgggaaaagaggagcggcttttggagtgatggaagccctgggaacactgccaggacacatgacagagagattccaggaagccattgacaacctcgctgtgctcatgcgggcagagactggaagcaggccttacaaagccgcggcggcccaattgccggagaccctagagaccattatgcttttggggttgctgggaacagtctcgctgggaatcttcttcgtcttgatgaggaacaagggcatagggaagatgggctttggaatggtgactcttggggccagcgcatggctcatgtggctctcggaaattgagccagccagaattgcatgtgtcctcattgttgtgtttctattgctggtggtgctcatacctgagccagaaaagcaaagatctccccaggacaaccaaatggcaatcatcatcatggtagcagtaggtcttctgggcttgattaccgccaatgaactcggatggttggagagaacaaagagtgacctaagccatctaatgggaaggagagaggagggggcaaccataggattctcaatggacattgacctgcggccagcctcagcttgggccatctatgctgccttgacaactttcattaccccagccgtccaacatgcagtgaccacttcatacaacaactactccttaatggcgatggccacgcaagctggagtgttgtttggtatgggcaaagggatgccattctacgcatgggactttggagtcccgctgctaatgataggttgctactcacaattaacacccctgaccctaatagtggccatcattttgctcgtggcgcactacatgtacttgatcccagggctgcaggcagcagctgcgcgtgctgcccagaagagaacggcagctggcatcatgaagaaccctgttgtggatggaatagtggtgactgacattgacacaatgacaattgacccccaagtggagaaaaagatgggacaggtgctactcatagcagtagccgtctccagcgccatactgtcgcggaccgcctgggggtggggggaggctggggccctgatcacagccgcaacttccactttgtgggaaggctctccgaacaagtactggaactcctctacagccacttcactgtgtaacatttttaggggaagttacttggctggagcttctctaatctacacagtaacaagaaacgctggcttggtcaagagacgtgggggtggaacaggagagaccctgggagagaaatggaaggcccgcttgaaccagatgtcggccctggagttctactcctacaaaaagtcaggcatcaccgaggtgtgcagagaagaggcccgccgcgccctcaaggacggtgtggcaacgggaggccatgctgtgtcccgaggaagtgcaaagctgagatggttggtggagcggggatacctgcagccctatggaaaggtcattgatcttggatgtggcagagggggctggagttactacgccgccaccatccgcaaagttcaagaagtgaaaggatacacaaaaggaggccctggtcatgaagaacccgtgttggtgcaaagctatgggtggaacatagtccgtcttaagagtggggtggacgtctttcatatggcggctgagccgtgtgacacgttgctgtgtgacataggtgagtcatcatctagtcctgaagtggaagaagcacggacgctcagagtcctctccatggtgggggattggcttgaaaaaagaccaggagccttttgtataaaggtgttgtgcccatacaccagcactatgatggaaaccctggagcgactgcagcgtaggtatgggggaggactggtcagagtgccactctcccgcaactctacacatgagatgtattgggtctctggagcgaaaagcaacaccataaaaagtgtgtccaccacgagccagctcctcttggggcgcatggacgggcctaggaggccagtgaaatatgaggaggatgtggatctcggctctggcacgcgggctgtggtaagctgcgctgaagctcccaacatgaagatcattggtaaccgcattgaaaggatccgcagtgagcacgcggaaacgtggttctttgacgagaaccacccatataggacatgggcttaccatggaagctatgaggcccccacacaagggtcagcgtcctctctaataaacggggttgtcaggctcctgtcaaaaccctgggatgtggtgactggagtcacaggaatagccatgaccgacaccacaccgtatggtcagcaaagagttttcaaggaaaaagtggacactagggtgccagacccccaagaaggcactcgtcaggttatgagcatggtctcttcctggttgtggaaagagctaggcaaacacaaacggccacgagtctgtaccaaagaagagttcatcaacaaggttcgtagcaatgcagcattaggggcaatatttgaagaggaaaaagagtggaagactgcagtggaagctgtgaacgatccaaggttctgggctctagtggataaggaaagagagcaccacctgagaggagagtgccagagttgtgtgtacaacatgatgggaaaaagagaaaagaaacaaggggaatttggaaaggccaagggcagccgcgccatctggtatatgtggctaggggctagatttctagagttcgaagcccttggattcttgaacgaggatcactggatggggagagagaactcaggaggtggtgttgaagggctgggattacaaagactcggatatgtcctagaagagatgagtcgtataccaggaggaaggatgtatgcagatgacactgctggctgggacacccgcatcagcaggtttgatctggagaatgaagctctaatcaccaaccaaatggaaaaagggcacagggccttggcattggccataatcaagtacacataccaaaacaaagtggtaaaggtccttagaccagctgaaaaagggaaaacagttatggacattatttcgagacaagaccaaagggggagcggacaagttgtcacttacgctcttaacacatttaccaacctagtggtgcaactcattcggaatatggaggctgaggaagttctagagatgcaagacttgtggctgctgcggaggtcagagaaagtgaccaactggttgcagagcaacggatgggataggctcaaacgaatggcagtcagtggagatgattgcgttgtgaagccaattgatgataggtttgcacatgccctcaggttcttgaatgatatgggaaaagttaggaaggacacacaagagtggaaaccctcaactggatgggacaactgggaagaagttccgttttgctcccaccacttcaacaagctccatctcaaggacgggaggtccattgtggttccctgccgccaccaagatgaactgattggccgggcccgcgtctctccaggggcgggatggagcatccgggagactgcttgcctagcaaaatcatatgcgcaaatgtggcagctcctttatttccacagaagggacctccgactgatggccaatgccatttgttcatctgtgccagttgactgggttccaactgggagaactacctggtcaatccatggaaagggagaatggatgaccactgaagacatgcttgtggtgtggaacagagtgtggattgaggagaacgaccacatggaagacaagaccccagttacgaaatggacagacattccctatttgggaaaaagggaagacttgtggtgtggatctctcatagggcacagaccgcgcaccacctgggctgagaacattaaaaacacagtcaacatggtgcgcaggatcataggtgatgaagaaaagtacatggactacctatccacccaagttcgctacttgggtgaagaagggtctacacctggagtgctgtaagcaccaatcttaatgttgtcaggcctgctagtcagccacagcttggggaaagctgtgcagcctgtgaccccccaggagaagctgggaaaccaagcctatagtcaggccgagaacgccatggcacggaagaagccatgctgcctgtgagcccctcagaggacactgagtcaaaaaaccccacgcgcttggaggcgcaggatgggaaaagaaggtggcgaccttccccacccttcaatctggggcctgaactggagatcagctgtggatctccagaagagggactagtggttagaggag

SEQ ID NO: 11 - DNA, 10662 bp, Zika virus
  Strain BeH819966 polyprotein gene
gtgaatcagactgcgacagttcgagtttgaagcgaaagctagcaacagtatcaacaggttttattttggatttggaaacgagagtttctggtcatgaaaaacccaaaaaagaaatccggaggattccggattgtcaatatgctaaaacgcggagtagcccgtgtgagcccctttgggggcttgaagaggctgccagccggacttctgctgggtcatgggcccatcaggatggtcttggcgattctagcctttttgagattcacggcaatcaagccatcactgggtctcatcaatagatggggttcagtggggaaaaaagaggctatggaaataataaagaagttcaagaaagatctggctgccatgctgagaataatcaatgctaggaaggagaagaagagacgaggcgcagatactagtgtcggaattgttggcctcctgctgaccacagctatggcagcggaggtcactagacgtgggagtgcatactatatgtacttggacagaaacgatgctggggaggccatatcttttccaaccacattggggatgaataagtgttatatacagatcatggatcttggacacatgtgtgatgccaccatgagctatgaatgccctatgctggatgagggggtggaaccagatgacgtcgattgttggtgcaacacgacgtcaacttgggttgtgtacggaacctgccatcacaaaaaaggtgaagcacggagatctagaagagctgtgacgctcccctcccattccactaggaagctgcaaacgcggtcgcaaacctggttggaatcaagagaatacacaaagcacttgattagagtcgaaaattggatattcaggaaccctggcttcgcgttagcagcagctgccatcgcttggcttttgggaagctcaacgagccaaaaagtcatatacttggtcatgatactgctgattgccccggcatacagcatcaggtgcataggagtcagcaatagggactttgtggaaggtatgtcaggtgggacctgggttgatgttgtcttggaacatggaggttgtgtcaccgtaatggcacaggacaaaccgactgtcgacatagagctggttacaacaacagtcagcaacatggcggaggtaagatcctactgctatgaggcatcaatatcagacatggcttcggacagccgctgcccaacacaaggtgaagcctaccttgacaagcaatcagacactcaatatgtctgcaaaagaacgttagtggacagaggctggggaaatggatgtggactttttggcaaagggagcctggtgacatgcgctaagtttgcatgctccaagaaaatgaccgggaagagcatccagccagagaatctggagtaccggataatgctgtcagttcatggctcccagcacagtgggatgattgttaatgacacaggacatgaaactgatgagaatagagcgaaagttgagataacgcccaattcaccaagagccgaagccaccctggggggttttggaagcctaggacttgattgtgaaccgaggacaggccttgacttttcagatttgtattacttgactatgaataacaagcactggttggttcacaaggagtggttccacgacattccattaccttggcacgctggggcagacaccggaactccacactggaacaacaaagaagcactggtagagttcaaggacgcacatgccaaaaggcaaactgtcgtggttctagggagtcaagaaggagcagttcacacggcccttgctggagctctggaggctgagatggatggtgcaaagggaaggctgtcctctggccacttgaaatgtcgcctgaaaatggataaacttagattgaagggcgtgtcatactccttgtgtactgcagcgttcacattcaccaagatcccggctgaaacactgcacgggacagtcacagtggaggtacagtacgcagggacagatggaccttgcaaggttccagctcagatggcggtggacatgcaaactctgaccccagttgggaggttgataaccgctaaccccgtaatcactgaaagcactgagaactctaagatgatgctggaacttgatccaccatttggggactcttacattgtcataggagtcggggagaagaagatcacccaccactggcacaggagtggcagcaccattggaaaagcatttgaagccactgtgagaggtgccaagagaatggcagtcttgggagacacagcctgggactttggatcagttggaggcgctctcaactcattgggcaagggcatccatcaaatttttggagcagctttcaaatcattgtttggaggaatgtcctggttctcacaaattctcattggaacgttgctgatgtggttgggtctgaacacaaagaatggatctatttcccttatgtgcttggccttagggggagtgttgatcttcttatccacagccgtctctgctgatgtggggtgctcggtggacttctcaaagaaggagacgagatgcggtacaggggtgttcgtctataacgacgttgaagcctggagggacaggtacaagtaccatcctgactccccccgtagattggcagcagcagtcaagcaagcctgggaagatggtatctgcgggatctcctctgtttcaagaatggaaaacatcatgtggagatcagtagaaggggagctcaacgcaatcctggaagagaatggagttcaactgacggtcgttgtgggatctgtaaaaaaccccatgtggagaggtccacagagattgcccgtgcctgtgaacgagctgccccacggctggaaggcttgggggaaatcgtacttcgtcagagcagcaaagacaaataacagctttgtcgtggatggtgacacactgaaggaatgcccactcaaacatagagcatggaacagctttcttgtggaggatcatgggttcggggtatttcacactagtgtctggctcaaggttagagaagattattcattagagtgtgatccagccgttattggaacagctgttaagggaaaggaggctgtacacagtgatctaggctactggattgagagtgagaagaatgacacatggaggctgaagagggcccatctgatcgagatgaaaacatgtgaatggccaaagtcccacacattgtggacagatggaatagaagagagtgatctgatcatacccaagtctttagctgggccactcagccatcacaataccagagagggctacaggacccaaatgaaagggccatggcacagtgaagagcttgaaattcggtttgaggaatgcccaggcactaaggtccacgtggaggaaacatgtggaacaagaggaccatctctgagatcaaccactgcaagcggaagggtgatcgaggaatggtgctgcagggagtgcacaatgcccccactgtcgttccgggctaaagatggctgttggtatggaatggagataaggcccaggaaagaaccagaaagcaacttagtaaggtcaatggtgactgcaggatcaactgatcacatggaccacttctcccttggagtgcttgtgattctgctcatggtgcaggaagggctgaagaagagaatgaccacaaagatcatcataagcacatcaatggcagtgctggtagctatgatcctgggaggattttcaatgagtgacctggctaagcttgcaattttgatgggtgccaccttcgcggaaatgaacactggaggagatgtagctcatctggcgctgatagcggcattcaaagtcagaccagcgttgctggtatctttcatcttcagagctaattggacaccccgtgaaagcatgctgctggccttggcctcgtgtcttttgcaaactgcgatctccgccttggaaggcgacctgatggttctcatcaatggttttgctttggcctggttggcaatacgagcgatggttgttccacgcactgataacatcaccttggcaatcctggctgctctgacaccactggcccggggcacactgcttgtggcgtggagagcaggccttgctacttgcggggggtttatgctcctctctctgaagggaaaaggcagtgtgaagaagaacttaccatttgtcatggccctgggactaaccgctgtgaggctggtcgaccccatcaacgtggtgggactgctgttgctcacaaggagtgggaagcggagctggccccctagcgaagtactcacagctgttggcctgatatgcgcattggctggagggttcgccaaggcagatatagagatggctgggcccatggccgcggtcggtctgctaattgtcagttacgtggtctcaggaaagagtgtggacatgtacattgaaagagcaggtgacatcacatgggaaaaagatgcggaagtcactggaaacagtccccggctcgatgtggcgctagatgagagtggtgatttctccctggtggaggatgacggtccccccatgagagagatcatactcaaggtggtcctgatgaccatctgtggcatgaacccaatagccataccctttgcagctggagcgtggtacgtatacgtgaagactggaaaaaggagtggtgctctatgggatgtgcctgctcccaaggaagtaaaaaagggggagaccacagatggagtgtacagagtaatgactcgtagactgctaggttcaacacaagttggagtgggagttatgcaagagggggtctttcacactatgtggcacgtcacaaaaggatccgcgctgagaagcggtgaagggagacttgatccatactggggagatgtcaagcaggatctggtgtcatactgtggtccatggaagctagatgccgcctgggacgggcacagcgaggtgcagctcttggccgtgccccccggagagagagcgaggaacatccagactctgcccggaatatttaagacaaaggatggggacattggagcggttgcgctggattacccagcaggaacttcaggatctccaatcctagacaagtgtgggagagtgataggactttatggcaatggggtcgtgatcaaaaatgggagttatgttagtgccatcacccaagggaggagggaggaagagactcctgttgagtgcttcgagccttcgatgctgaagaagaagcagctaactgtcttagacttgcatcctggagctgggaaaaccaggagagttcttcctgaaatagtccgtgaagccataaaaacaagactccgtactgtgatcttagctccaaccagggttgtcgctgctgaaatggaggaggcccttagagggcttccagtgcgttatatgacaacagcagtcaatgtcacccactctggaacagaaatcgtcgacttaatgtgccatgccaccttcacttcacgtctactacagccaatcagagtccccaactataatctgtatattatggatgaggcccacttcacagatccctcaagtatagcagcaagaggatacatttcaacaagggttgagatgggcgaggcggctgccatcttcatgaccgccacgccaccaggaacccgtgacgcatttccggactccaactcaccaattatggacaccgaagtggaagtcccagagagagcctggagctcaggctttgattgggtgacggatcattctggaaaaacagtttggtttgttccaagcgtgaggaacggcaatgagatcgcagcttgtctgacaaaggctggaaaacgggtcatacagctcagcagaaagacttttgagacagagttccagaaaacaaaacatcaagagtgggactttgtcgtgacaactgacatttcagagatgggcgccaactttaaagctgaccgtgtcatagattccaggagatgcctaaagccggtcatacttgatggcgagagagtcattctggctggacccatgcctgtcacacatgccagcgctgcccagaggagggggcgcataggcaggaatcccaacaaacctggagatgagtatctgtatggaggtgggtgcgcagagactgacgaagaccatgcacactggcttgaagcaagaatgctccttgacaatatttacctccaagatggcctcatagcctcgctctatcgacctgaggccgacaaagtagcagccattgagggagagttcaagcttaggacggagcaaaggaagacctttgtggaactcatgaaaagaggagatcttcctgtttggctggcctatcaggttgcatctgccggaataacctacacagatagaagatggtgctttgatggcacgaccaacaacaccataatggaagacagtgtgccggcagaggtgtggaccagacacggagagaaaagagtgctcaaaccgaggtggatggacgccagagtttgttcagatcatgcggccctgaagtcattcaaggagtttgccgctgggaaaagaggagcggcttttggagtgatggaagccctgggaacactgccaggacacatgacagagagattccaggaagccattgacaacctcgctgtgctcatgcgggcagagactggaagcaggccttacaaagccgcggcggcccaattgccggagaccctagagaccattatgcttttggggttgctgggaacagtctcgctgggaatcttcttcgtcttgatgaggaacaagggcatagggaagatgggctttggaatggtgactcttggggccagcgcatggctcatgtggctctcggaaattgagccagccagaattgcatgtgtcctcattgttgtgtttctattgctggtggtgctcatacctgagccagaaaagcaaagatctccccaggacaaccaaatggcaatcatcatcatggtagcagtaggtcttctgggcttgattaccgccaatgaactcggatggttggagagaacaaagagtgacctaagccatctaatgggaaggagagaggagggggcaaccataggattctcaatggacattgacctgcggccagcctcagcttgggccatctatgctgccttgacaactttcattaccccagccgtccaacatgcagtgaccacttcatacaacaactactccttaatggcgatggccacgcaagctggagtgttgtttggtatgggcaaagggatgccattctacgcatgggactttggagtcccgctgctaatgataggttgctactcacaattaacacccctgaccctaatagtggccatcattttgctcgtggcgcactacatgtacttgatcccagggctgcaggcagcagctgcgcgtgctgcccagaagagaacggcagctggcatcatgaagaaccctgttgtggatggaatagtggtgactgacattgacacaatgacaattgacccccaagtggagaaaaagatgggacaggtgctactcatagcagtagccgtctccagcgccatactgtcgcggaccgcctgggggtggggggaggctggggccctgatcacagccgcaacttccactttgtgggaaggctctccgaacaagtactggaactcctctacagccacttcactgtgtaacatttttaggggaagttacttggctggagcttctctaatctacacagtaacaagaaacgctggcttggtcaagagacgtgggggtggaacaggagagaccctgggagagaaatggaaggcccgcttgaaccagatgtcggccctggagttctactcctacaaaaagtcaggcatcaccgaggtgtgcagagaagaggcccgccgcgccctcaaggacggtgtggcaacgggaggccatgctgtgtcccgaggaagtgcaaagctgagatggttggtggagcggggatacctgcagccctatggaaaggtcattgatcttggatgtggcagagggggctggagttactacgccgccaccatccgcaaagttcaagaagtgaaaggatacacaaaaggaggccctggtcatgaagaacccgtgttggtgcaaagctatgggtggaacatagtccgtcttaagagtggggtggacgtctttcatatggcggctgagccgtgtgacacgttgctgtgtgacataggtgagtcatcatctagtcctgaagtggaagaagcacggacgctcagagtcctctccatggtgggggattggcttgaaaaaagaccaggagccttttgtataaaggtgttgtgcccatacaccagcactatgatggaaaccctggagcgactgcagcgtaggtatgggggaggactggtcagagtgccactctcccgcaactctacacatgagatgtattgggtctctggagcgaaaagcaacaccataaaaagtgtgtccaccacgagccagctcctcttggggcgcatggacgggcctaggaggccagtgaaatatgaggaggatgtgaatctcggctctggcacgcgggctgtggtaagctgcgctgaagctcccaacatgaagatcattggtaaccgcattgaaaggatccgcagtgagcacgcggaaacgtggttctttgacgagaaccacccatataggacatgggcttaccatggaagctatgaggcccccacacaagggtcagcgtcctctctaataaacggggttgtcaggctcctgtcaaaaccctgggatgtggtgactggagtcacaggaatagccatgaccgacaccacaccgtatggtcagcaaagagttttcaaggaaaaagtggacactagggtgccagacccccaagaaggcactcgtcaggttatgagcatggtctcttcctggttgtggaaagagctaggcaaacacaaacggccacgagtctgtaccaaagaagagttcatcaacaaggttcgtagcaatgcagcattaggggcaatatttgaagaggaaaaagagtggaagactgcagtggaagctgtgaacgatccaaggttctgggctctagtggataaggaaagagagcaccacctgagaggagagtgccagagttgtgtgtacaacatgatgggaaaaagagaaaagaaacaaggggaatttggaaaggccaagggcagccgcgccatctggtatatgtggctaggggctagatttctagagttcgaagcccttggattcttgaacgaggatcactggatggggagagagaactcaggaggtggtgttgaagggctgggattacaaagactcggatatgtcctagaagagatgagtcgtataccaggaggaaggatgtatgcagatgacactgctggctgggacacccgcatcagcaggtttgatctggagaatgaagctctaatcaccaaccaaatggaaaaagggcacagggccttggcattggccataatcaagtacacataccaaaacaaagtggtaaaggtccttagaccagctgaaaaagggaaaacagttatggacattatttcgagacaagaccaaagggggagcggacaagttgtcacttacgctcttaacacatttaccaacctagtggtgcaactcattcggaatatggaggctgaggaagttctagagatgcaagacttgtggctgctgcggaggtcagagaaagtgaccaactggttgcagagcaacggatgggataggctcaaacgaatggcagtcagtggagatgattgcgttgtgaagccaattgatgataggtttgcacatgccctcaggttcttgaatgatatgggaaaagttaggaaggacacacaagagtggaaaccctcaactggatgggacaactgggaagaagttccgttttgctcccaccacttcaacaagctccatctcaaggacgggaggtccattgtggttccctgccgccaccaagatgaactgattggccgggcccgcgtctctccaggggcgggatggagcatccgggagactgcttgcctagcaaaatcatatgcgcaaatgtggcagctcctttatttccacagaagggacctccgactgatggccaatgccatttgttcatctgtgccagttgactgggttccaactgggagaactacctggtcaatccatggaaagggagaatggatgaccactgaagacatgcttgtggtgtggaacagagtgtggattgaggagaacgaccacatggaagacaagaccccagttacgaaatggacagacatcccctatttgggaaaaagggaagacttgtggtgtggatctctcatagggcacagaccgcgcaccacctgggctgagaacattaaaaacacagtcaacatggtgcgcaggatcataggtgatgaagaaaagtacatggactacctatccacccaagttcgctacttgggtgaagaagggtctacacctggagtgctgtaagcaccagtcttaatgttgtcaggcctgctagtcagccacagcttggggaaagctgtgcagcctgtgaccccccaggagaagctgggaaaccaagcctatagtcaggccgagaacgccatggcacggaagaagccatgctgcctgtgagcccctcagaggacactgagtcaaaaaaccccacgcgcttggaggcgcaggatgggaaaagaaggtggcgaccttccccacccttcaatctggggcctgaactggagatcagctgtggatctccagaagagggactagtggttagaggag

SEQ ID NO: 12 - DNA, 10727 bp, Zika virus
  Strain BeH819015 polyprotein gene
tgtgaatcagactgcgacagttcgagtttgaagcgaaagctagcaacagtatcaacaggttttattttggatttggaaacgagagtttctggtcatgaaaaacccaaaaaagaaatccggaggattccggattgtcaatatgctaaaacgcggagtagcccgtgtgagcccctttgggggcttgaagaggctgccagccggacttctgctgggtcatgggcccatcaggatggtcttggcgattctagcctttttgagattcacggcaatcaagccatcactgggtctcatcaatagatggggttcagttgggaaaaaagaggctatggaaataataaagaagttcaagaaagatctggctgccatgctgagaataatcaatgctaggaaggagaagaagagacgaggcgcagatactagtgtcggaattgttggcctcctgctgaccacagctatggcagcggaggtcactagacgtgggagtgcatactatatgtacttggacagaaacgatgctggggaggccatatcttttccaaccacattggggatgaataagtgttatatacagatcatggatcttggacacatgtgtgatgccaccatgagctatgaatgccctatgctggatgagggggtggaaccagatgacgtcgattgttggtgcaacacgacgtcaacttgggttgtgtacggaacctgccatcacaaaaaaggtgaagcacggagatctagaagagctgtgacgctcccctcccattccactaggaagctgcaaacgcggtcgcaaacctggttggaatcaagagaatacacaaagcacttgattagagtcgaaaattggatattcaggaaccctggcttcgcgttagcagcagctgccatcgcttggcttttgggaagctcaacgagccaaaaagtcatatacttggtcatgatactgctgattgccccggcatacagcatcaggtgcataggagtcagcaatagggactttgtggaaggtatgtcaggtgggacttgggttgatgttgtcttggaacatggaggttgtgtcaccgtaatggcacaggacaaaccgactgtcgacatagagctggttacaacaacagtcagcaacatggcggaggtaagatcctactgctatgaggcatcaatatcagacatggcttcggacagccgctgcccaacacaaggtgaagcctaccttgacaagcaatcagacactcaatatgtctgcaaaagaacgttagtggacagaggctggggaaatggatgtggactttttggcaaagggagcctggtgacatgcgctaagtttgcatgctccaagaaaatgaccgggaagagcatccagccagagaatctggagtaccggataatgctgtcagttcatggctcccagcacagtgggatgatcgttaatgacacaggacatgaaactgatgagaatagagcgaaagttgagataacgcccaattcaccaagagccgaagccaccctggggggttttggaagcctaggacttgattgtgaaccgaggacaggccttgacttttcagatttgtattacttgactatgaataacaagcactggttggttcacaaggagtggttccacgacattccattaccttggcacgctggggcagacaccggaactccacactggaacaacaaagaagcactggtagagttcaaggacgcacatgccaaaaggcaaactgtcgtggttctagggagtcaagaaggagcagttcacacggcccttgctggagctctggaggctgagatggatggtgcaaagggaaggctgtcctctggccacttgaaatgtcgcctgaaaatggataaacttagattgaagggcgtgtcatactccttgtgtactgcagcgttcacattcaccaagatcccggctgaaacactgcacgggacagtcacagtggaggtacagtacgcagggacagatggaccttgcaaggttccagctcagatggcggtggacatgcaaactctgaccccagttgggaggttgataaccgctaaccccgtaatcactgaaagcactgagaactctaagatgatgctggaacttgatccaccatttggggactcttacattgtcataggagtcggggagaagaagatcacccaccactggcacaggagtggcagcaccattggaaaagcatttgaagccactgtgagaggtgccaagagaatggcagtcttgggagacacagcctgggactttggatcagttggaggcgctctcaactcattgggcaagggcatccatcaaatttttggagcagctttcaaatcattgtttggaggaatgtcctggttctcacaaattctcattggaacgttgctgatgtggttgggtctgaacacaaagaatggatctatttcccttatgtgcttggccttagggggggtgttgatcttcttatccacagccgtctctgctgatgtggggtgctcggtggacttctcaaagaaggagacgagatgcggtacaggggtgttcgtctataacgacgttgaagcctggagggacaggtacaagtaccatcctgactccccccgtagattggcagcagcagtcaagcaagcctgggaagatggtatctgcgggatctcctctgtttcaagaatggaaaacatcatgtggagatcagtagaaggggagctcaacgcaatcctggaagagaatggagttcaactgacggtcgttgtgggatctgtaaaaaaccccatgtggagaggtccacagagattgcccgtgcctgtgaacgagctgccccacggctggaaggcttgggggaaatcgtacttcgtcagagcagcaaagacaaataacagctttgtcgtggatggtgacacactgaaggaatgcccactcaaacatagagcatggaacagctttcttgtggaggatcatgggttcggggtatttcacactagtgtctggctcaaggttagagaagattattcattagagtgtgatccagccgttattggaacagctgttaagggaaaggaggctgtacacagtgatctaggctactggattgagagtgagaagaatgacacatggaggctgaagagggcccatctgatcgagatgaaaacatgtgaatggccaaagtcccacacattgtggacagatggaatagaagagagtgatctgatcatacccaagtctttagctgggccactcagccatcacaataccagagagggctacaggacccaaatgaaagggccatggcacagtgaagagcttgaaattcggtttgaggaatgcccaggcactaaggtccacgtggaggaaacatgtggaacaagaggaccatctctgagatcaaccactgcaagcggaagggtgatcgaggaatggtgctgcagggagtgcacaatgcccccactgtcgttccgggctaaagatggctgttggtatggaatggagataaggcccaggaaagaaccagaaagcaacttagtaaggtcaatggtgactgcaggatcaactgatcacatggaccacttctcccttggagtgcttgtgatcctgctcatggtgcaggaagggctgaagaagagaatgaccacaaagatcatcataagcacatcaatggcagtgctggtagctatgatcctgggaggattttcaatgagtgacctggctaagcttgcaattttgatgggtgccaccttcgcggaaatgaacactggaggagatgtagctcatctggcgctgatagcggcattcaaagtcagaccagcgttgctggtatctttcatcttcagagctaattggacaccccgtgaaagcatgctgctggccttggcctcgtgtcttttgcaaactgcgatctccgccttggaaggcgacctgatggttctcatcaatggttttgctttggcctggttggcaatacgagcgatggttgttccacgcactgataacatcaccttggcaatcctggctgctctgacaccactggcccggggcacactgcttgtggcgtggagagcaggccttgctacttgcggggggtttatgctcctctctctgaagggaaaaggcagtgtgaagaagaacttaccatttgtcatggccctgggactaaccgctgtgaggctggtcgaccccatcaacgtggtgggactgctgttactcacaaggagtgggaagcggagctggccccctagcgaagtactcacagctgttggcctgatatgcgcattggctggagggttcgccaaggcagatatagagatggctgggcccatggccgcggtcggtctgctaattgtcagttacgtggtctcaggaaagagtgtggacatgtacattgaaagagcaggtgacatcacatgggaaaaagatgcggaagtcactggaaacagtccccggctcgatgtggcgctagatgagagtggtgatttctccctggtggaggatgacggtccccccatgagagagatcatactcaaggtggtcctgatgaccatctgtggcatgaatccaatagccataccctttgcagctggagcgtggtacgtatacgtgaagactggaaaaaggagtggtgctctatgggatgtgcctgctcccaaggaagtaaaaaagggggagaccacagatggagtgtacagagtaatgactcgtagactgctaggttcaacacaagttggagtgggagttatgcaagagggggtctttcacactatgtggcacgtcacaaaaggatccgcgctgagaagcggtgaagggagacttgatccatactggggagatgtcaagcaggatctggtgtcatactgtggtccatggaagctagatgccgcctgggacgggcacagcgaggtgcagctcttggccgtgccccccggagagagagcgaggaacatccagactctgcccggaatatttaagacaaaggatggggacattggagcggttgcgctggattacccagcaggaacttcaggatctccaatcctagacaagtgtgggagagtgataggactttatggcaatggggtcgtgatcaaaaatgggagttatgttagtgccatcacccaagggaggagggaagaagagactcctgttgagtgcttcgagccctcgatgctgaagaagaagcagctaactgtcttagacttgcatcctggagctgggaaaaccaggagagttcttcctgaaatagtccgtgaagccataaaaacaagactccgtactgtgatcttagctccaaccagggttgtcgctgctgaaatggaggaggcccttagagggcttccagtgcgttatatgacaacagcagtcaatgtcacccactctggaacagaaatcgtcgacttaatgtgccatgccaccttcacttcacgtctactacagccaatcagagtccccaactataatctgtatattatggatgaggcccacttcacagatccctcaagtatagcagcaagaggatacatttcaacaagggttgagatgggcgaggcggctgccatcttcatgaccgccacgccaccaggaacccgtgacgcatttccggactccaactcaccaattatggacaccgaagtggaagtcccagagagagcctggagctcaggctttgattgggtgacggatcattctggaaaaacagtttggtttgttccaagcgtgaggaacggcaatgagatcgcagcttgtctgacaaaggctggaaaacgggtcatacagctcagcagaaagacttttgagacagagttccagaaaacaaaacatcaagagtgggactttgtcgtgacaactgacatttcagagatgggcgccaactttaaagctgaccgtgtcatagattccaggagatgcctaaagccggtcatacttgatggcgagagagtcattctggctggacccatgcctgtcacacatgccagcgctgcccagaggagggggcgcataggcaggaatcccaacaaacctggagatgagtatctgtatggaggtgggtgcgcagagactgacgaagaccatgcacactggcttgaagcaagaatgctccttgacaatatttacctccaagatggcctcatagcctcgctctatcgacctgaggccgacaaagtagcagccattgagggagagttcaagcttaggacggagcaaaggaagacctttgtggaactcatgaaaagaggagatcttcctgtttggctggcctatcaggttgcatctgccggaataacctacacagatagaagatggtgctttgatggcacgaccaacaacaccataatggaagatagtgtgccggcagaggtgtggaccagacacggagagaaaagagtgctcaaaccgaggtggatggacgccagagtttgttcagatcatgcggccctgaagtcattcaaggagtttgccgctgggaaaagaggagcggcttttggagtgatggaagccctgggaacactgccaggacacatgacagagagattccaggaagccattgacaacctcgctgtgctcatgcgggcagagactggaagcaggccttacaaagccgcggcggcccaattgccggagaccctagagaccataatgcttttggggttgctgggaacagtctcgctgggaatcttcttcgtcttgatgaggaacaagggcatagggaagatgggctttggaatggtgactcttggggccagcgcatggctcatgtggctctcggaaattgagccagccagaattgcatgtgtcctcattgttgtgttcctattgctggtggtgctcatacctgagccagaaaagcaaagatctccccaggacaaccaaatggcaatcatcatcatggtagcagtaggtcttctgggcttgattaccgccaatgaactcggatggttggagagaacaaagagtgacctaagccatctaatgggaaggagagaggagggggcaaccataggattctcaatggacattgacctgcggccagcctcagcttgggccatctatgctgccttgacaactttcattaccccagccgtccaacatgcagtgaccacctcatacaacaactactccttaatggcgatggccacgcaagctggagtgttgtttggtatgggcaaagggatgccattctacgcatgggactttggagtcccgctgctaatgataggttgctactcacaattaacacccctgaccctaatagtggccatcattttgctcgtggcgcactacatgtacttgatcccagggctgcaggcagcagctgcgcgtgctgcccagaagagaacggcagctggcatcatgaagaaccctgttgtggatggaatagtggtgactgacattgacacaatgacaattgacccccaagtggagaaaaagatgggacaggtgctactcatagcagtagccgtctccagcgccatactgtcgcggaccgcctgggggtggggggaggctggggccctgatcacagccgcaacttccactttgtgggaaggctctccgaacaagtactggaactcctctacagccacttcactgtgtaacatttttaggggaagttacttggctggagcttctctaatctacacagtaacaagaaacgctggcttggtcaagagacgtgggggtggaacaggagagaccctgggagagaaatggaaggcccgcttgaaccagatgtcggccctggagttctactcctacaaaaagtcaggcatcaccgaggtgtgcagagaagaggcccgccgcgccctcaaggacggtgtggcaacgggaggccatgctgtgtcccgaggaagtgcaaagctgagatggttggtggagcggggatacctgcagccctatggaaaggtcattgatcttggatgtggcagagggggctggagttactacgccgccaccatccgcaaagttcaagaagtgaaaggatacacaaaaggaggccctggtcatgaagaacccgtgttggtgcaaagctatgggtggaacatagtccgtcttaagagtggggtggacgtctttcatatggcggctgagccgtgtgacacgctgctgtgtgacataggtgagtcatcatctagtcctgaagtggaagaagcacggacgctcagagtcctctccatggtgggggattggcttgaaaaaagaccaggagccttttgtataaaagtgttgtgcccatacaccagcactatgatggaaaccctggagcgactgcagcgtaggtatgggggaggactggtcagagtgccactctcccgcaactctacacatgagatgtactgggtctctggagcgaaaagcaacaccataaaaagtgtgtccaccacgagccagctcctcttggggcgcatggacgggcctaggaggccagtgaaatatgaggaggatgtgaatctcggctctggcacgcgggctgtggtaagctgcgctgaagctcccaacatgaagatcattggtaaccgcattgaaaggatccgcagtgagcacgcggaaacgtggttctttgacgagaaccacccatataggacatgggcttaccatggaagctatgaggcccccacacaagggtcagcgtcctctctaataaacggggttgtcaggctcctgtcaaaaccctgggatgtggtgactggagtcacaggaatagccatgaccgacaccacaccgtatggtcagcaaagagttttcaaggaaaaagtggacactagggtgccagacccccaagaaggcactcgtcaggttatgagcatggtctcttcctggttgtggaaagagctaggcaaacacaaacggccacgagtctgtaccaaagaagagttcatcaacaaggttcgtagcaatgcagcattaggggcaatatttgaagaggaaaaagagtggaagactgcagtggaagctgtgaacgatccaaggttctgggctctagtggacaaggaaagagagcaccacctgagaggagagtgccagagttgtgtgtataacatgatgggaaaaagagaaaagaaacaaggggaatttggaaaggccaagggcagccgcgccatctggtatatgtggctaggggctagatttctagagttcgaagcccttggattcttgaacgaggatcactggatggggagagagaactcaggaggtggtgttgaagggctgggattacaaagactcggatatgtcctagaagagatgagtcgtataccaggaggaaggatgtatgcagatgacactgctggctgggacacccgcattagcaggtttgatctggagaatgaagctctaatcaccaaccaaatggagaaagggcacagggccttggcattggccataatcaagtacacataccaaaacaaagtggtaaaggtccttagaccagctgaaaaagggaaaacagttatggacattatttcgagacaagaccaaagggggagcggacaagttgtcacttacgctcttaacacatttaccaacctagtggtgcaactcattcggaatatggaggctgaggaagttctagagatgcaagacttgtggctgctgcggaggtcagagaaagtgaccaactggttgcagagcaacggatgggataggctcaaacgaatggcagtcagtggagatgattgcgttgtgaagccaattgatgataggtttgcacatgccctcaggttcttgaatgatatgggaaaagttagaaaggacacacaagagtggaaaccctcaactggatgggacaactgggaagaagttccgttttgctcccaccacttcaacaagctccatctcaaggacgggaggtccattgtggttccctgccgccaccaagatgaactgattggccgggcccgcgtctctccaggggcgggatggagcatccgggagactgcttgcctagcaaaatcatatgcgcagatgtggcagctcctttatttccacagaagggacctccgactgatggccaatgccatttgttcatctgtgccagttgactgggttccaactgggagaactacctggtcaatccatggaaagggagaatggatgaccactgaagacatgcttgtggtgtggaacagagtgtggattgaggagaacgaccacatggaagacaagaccccagttacgaaatggacagacattccctatttgggaaaaagggaagacttgtggtgtggatctctcatagggcacagaccgcgcaccacctgggctgagaacattaaaaacacagtcaacatggtgcgcaggatcataggtgatgaagaaaagtacatggactacctatccacccaagttcgctacttgggtgaagaagggtctacacctggagtgctgtaagcaccaatcttaatgttgtcaggcctgctagtcagccacagcttggggaaagctgtgcagcctgtgaccccccaggagaagctgggaaaccaagcctatagtcaggccgagaacgccatggcacggaagaagccatgctgcctgtgagcccctcagaggatactgagtcaaaaaaccccacgcgcttggaggcgcaggatgggaaaagaaggtggcgaccttccccacccttcaatctggggcctgaactggagatcagctgtggatccccagaagagggactagtggttagaggagaccccccggaaaacgcaaaacagcatattgacgctgggaaagaccagagactccatgagtttcc

SEQ ID NO: 13 - DNA, 10374 bp, Zika virus
  Isolate Z1106033 polyprotein gene
acaggttttattttggatttggaaacgagagtttctggtcatgaaaaacccaaaaaagaaatccggaggattccggattgtcaatatgctaaaacgcggagtagcccgtgtgagcccctttgggggcttgaagaggctgccagccggacttctgctgggtcatgggcccatcaggatggtcttggcgattctagcctttttgagattcacggcaatcaagccatcactgggtctcatcaatagatggggttcagtggggaaaaaagaggctatggaaataataaagaagttcaagaaagatctggctgccatgctgagaataatcaatgctaggaaggagaagaagagacgaggcgcagatactagtgtcggaattgttggcctcctgctgaccacagctatggcagcggaggtcactagacgtgggagtgcatactatatgtacttggacagaaacgatgctggggaggccatatcttttccaaccacattggggatgaataagtgttatatacagatcatggatcttggacacacgtgtgatgccaccatgagctatgaatgccctatgctggatgagggggtggaaccagatgacgtcgattgttggtgcaacacgacgtcaacttgggttgtgtacggaacctgccatcacaaaaaaggtgaagcacggagatctagaagagctgtgacgctcccctcccattccactaggaagctgcaaacgcggtcgcaaacctggttggaatcaagagaatacacaaagcacttgattagagtcgaaaattggatattcaggaaccctggcttcgcgttagcagcagctgccatcgcttggcttttgggaagctcaacgagccaaaaagtcatatacttggtcatgatactgctgattgccccggcatacagcatcaggtgcataggagtcagcaatagggactttgtggaaggtatgtcaggtgggacttgggttgatgttgtcttggaacatggaggttgtgtcactgtaatggcacaggacaaaccgactgtcgacatagagctggttacaacaacagtcagcaacatggcggaggtaagatcctactgctatgaggcatcaatatcagacatggcttcggacagccgctgcccaacacaaggtgaagcctaccttgacaagcaatcagacactcaatatgtctgcaaaagaacgttagtggacagaggctggggaaatggatgtggactttttggcaaagggagcctggtgacatgcgctaagtttgcatgctccaagaaaatgaccgggaagagcatccagccagagaatctggagtaccggataatgctgtcagttcatggctcccagcacagtgggatgatcgttaatgacacaggacatgaaactgatgagaatagagcgaaagttgagataacgcccaattcaccaagagccgaagccaccctgggggggtttggaagcctaggacttgattgtgaaccgaggacaggccttgacttttcagatttgtattacttgactatgaataacaagcactggctggttcacaaggagtggttccacgacattccattaccttggcacgctggggcagacaccggaactccacactggaacaacaaagaagcactggtagagttcaaggacgcacatgccaaaaggcaaactgtcgtggttctagggagtcaagaaggagcagttcacacggcccttgctggagctctggaggctgagatggatggtgcaaagggaaggctgtcctctggccacttgaaatgtcgcctgaaaatggataaacttagattgaagggcgtgtcatactccttgtgtactgcagcgttcacattcaccaagatcccggctgaaacactgcacgggacagtcacagtggaggtacagtacgcagggacagatggaccttgcaaggttccagctcagatggcggtggacatgcaaactctgaccccagttgggaggttgataaccgctaaccccgtaatcactgaaagcactgagaactctaagatgatgctggaacttgatccaccatttggggactcttacattgtcataggagtcggggagaagaagatcacccaccactggcacaggagtggcagcaccattggaaaagcatttgaagccactgtgagaggtgccaagagaatggcagtcttgggagacacagcctgggactttggatcagttggaggcgctctcaactcattgggcaagggcatccatcaaatctttggagcagctttcaaatcattgtttggaggaatgtcctggttctcacaaattctcattggaacgttgctgatgtggttgggtctgaacgcaaagaatggatctatttcccttatgtgcttggccttagggggagtgttgatcttcttatccacagccgtctctgctgatgtggggtgctcggtggacttctcaaagaaggagacgagatgcggtacaggggtgttcgtctataacgacgttgaagcctggagggacaggtacaagtaccatcctgactccccccgtagattggcagcagcagtcaagcaagcctgggaagatggtatctgcgggatctcctctgtttcaagaatggaaaacatcatgtggagatcagtagaaggggagctcaacgcaatcctggaagagaatggagttcaactgacggtcgttgtgggatctgtaaaaaaccccatgtggagaggtccacagagattgcccgtgcctgtgaacgagctgccccacggctggaaggcttgggggaaatcgtacttcgtcagagcagcaaagacaaataacagctttgtcgtggatggtgacacactgaaggaatgcccactcaaacatagagcatggaacagctttcttgtggaggatcatgggttcggggtatttcacactagtgtctggctcaaggttagagaagattattcattagagtgtgatccagccgttattggaacagctgttaagggaaaggaggctgtacacagtgatctaggctactggattgagagtgagaagaatgacacatggaggctgaagagggcccatctgatcgagatgaaaacatgtgaatggccaaagtcccacacattgtggacagatggaatagaagagagtgatctgatcatacccaagtctttagctgggccactcagccatcacaataccagagagggctacaggacccaaatgaaagggccatggcacagtgaagagcttgaaattcggtttgaggaatgcccaggcactaaggtccacgtggaggaaacatgtggaacgagaggaccatctctgagatcaaccactgcaagcggaagggtgatcgaggaatggtgctgcagggagtgcacaatgcccccactgtcgttccgggctaaagatggctgttggtatggaatggagataaggcccaggaaagaaccagaaagcaacttagtaaggtcaatggtgactgcaggatcaactgatcacatggaccacttctcccttggagtgcttgtgattctgctcatggtgcaggaagggttgaagaagagaatgaccacaaagatcatcataagcacatcaatggcagtgctggtagctatgatcctgggaggattttcaatgagtgacctggctaagcttgcaattttgatgggtgccaccttcgcggaaatgaacactggaggagatgtagctcatctggcgctgatagcggcattcaaagtcagaccagcgttgctggtatctttcatcttcagagctaattggacaccccgtgaaagcatgctgctggccttggcctcgtgtcttttgcaaactgcgatctccgccttggaaggcgacctgatggttctcatcaatggttttgctttggcctggttggcaatacgagcgatggttgttccacgcactgataacatcaccttggcaatcctggctgctctgacaccactggcccggggcacactgcttgtggcgtggagagcaggccttgctacttgcggggggtttatgctcctctctctgaagggaaaaggcagtgtgaagaagaacttaccatttgtcatggccctgggactaaccgctgtgaggctggtcgaccccatcaacgtggtgggactgctgttgctcacaaggagtgggaagcggagctggccccctagcgaagtactcacagctgttggcctgatatgcgcattggctggagggttcgccaaggcagatatagagatggctgggcccatggccgcggtcggtctgctaattgtcagttacgtggtctcaggaaagagtgtggacatgtacattgaaagagcaggtgacatcacatgggaaaaagatgcggaagtcactggaaacagtccccggctcgatgtggcgctagatgagagtggtgatttctccctggtggaggatgacggtccccccatgagagagatcatactcaaggtggtcctgatgaccatctgtggcatgaacccaatagccataccctttgcagctggagcgtggtacgtatacgtgaagactggaaaaaggagtggtgctctatgggatgtgcctgctcccaaggaagtaaaaaagggggagaccacagatggagtgtacagagtaatgactcgtagactgctaggttcaacacaagttggagtgggagttatgcaagagggggtctttcacactatgtggcacgtcacaaaaggatccgcgctgagaagcggtgaagggagacttgatccatactggggagatgtcaagcaggatctggtgtcatactgtggtccatggaagctagatgccgcctgggacgggcacagcgaggtgcagctcttggccgtgccccccggagagagagcgaggaacatccagactctgcccggaatatttaagacaaaggatggggacattggagcggttgcgctggattacccagcaggaacttcaggatctcctatcctagacaagtgtgggagagtgataggactttatggcaatggggtcgtgatcaaaaatgggagttatgttagtgccatcacccaagggaggagggaggaagagactcctgttgagtgcttcgagccttcgatgctgaagaagaagcagctaactgtcttagacttgcatcctggagctgggaaaaccaggagagttcttcctgaaatagtccgtgaagccataaaaacaagactccgtactgtgatcttagctccaaccagggttgtcgctgctgaaatggaggaggcccttagagggcttccagtgcgttatatgacaacagcagtcaatgtcacccactctggaacagaaatcgtcgacttaatgtgccatgccaccttcacttcgcgtctactacagccaatcagagtccccaactataatctgtatattatggatgaggcccacttcacagatccctcaagtatagcagcaagaggatacatttcaacaagggttgagatgggcgaggcggccgccatcttcatgaccgccacgccaccaggaacccgtgacgcatttccggactccaactcaccaattatggacaccgaagtggaagtcccagagagagcctggagctcaggctttgattgggtgacggatcattctggaaaaacagtttggtttgttccaagcgtgaggaacggcaatgagatcgcagcttgtctgacaaaggctggaaaacgggtcatacagctcagcagaaagacttttgagacagagttccagaaaacaaaacatcaagagtgggactttgtcgtgacaactgacatttcagagatgggcgccaactttaaagctgaccgtgtcatagattccaggagatgcctaaagccggtcatacttgatggcgagagagtcattctggctggacccatgcctgtcacacatgccagcgctgcccagaggagggggcgcataggcaggaatcccaacaaacctggagatgagtatctgtatggaggtgggtgcgcagagactgacgaagaccatgcacactggcttgaagcaagaatgctccttgacaatatttacctccaagatggcctcatagcctcgctctatcgacctgaggccgacaaagtagcagccattgagggagagttcaagcttaggacggagcaaaggaagacctttgtggaactcatgaaaagaggagatcttcctgtttggctggcctatcaggttgcatctgccggaataacctacacagatagaagatggtgctttgatggcacgaccaacaacaccataatggaagacagtgtgccggcagaagtgtggaccagacacggagagaaaagagtgctcaaaccgaggtggatggacgccagagtttgttcagatcatgcggccctgaagtcattcaaggagtttgccgctgggaaaagaggagcggcttttggagtgatggaagccctgggaacactgccaggacacatgacagagagattccaggaagccattgacaacctcgctgtgctcatgcgggcagagactggaagcaggccttacaaagccgcggcggcccaattgccggagaccctagagaccattatgcttttggggttgctgggaacagtctcgctgggaatcttcttcgtcttgatgaggaacaagggcatagggaagatgggctttggaatggtgactcttggggccagcgcatggctcatgtggctctcggaaattgagccagccagaattgcatgtgtcctcattgttgtgttcctattgctggtggtgctcatacctgagccagaaaagcaaagatctccccaggacaaccaaatggcaatcatcatcatggtagcagtaggtcttctgggcttgattaccgccaatgaactcggatggttggagagaacaaagagtgacctaagccatctaatgggaaggagagaggagggggcaaccataggattctcaatggacattgacctgcggccagcctcagcttgggccatctatgctgccttgacaactttcattaccccagccgtccaacatgcagtgaccacctcatacaacaactactccttaatggcgatggccacgcaagctggagtgttgtttggtatgggcaaagggatgccattctacgcatgggactttggagtcccgctgctaatgataggttgctactcacaattaacacccctgaccctaatagtggccatcattttgctcgtggcgcactacatgtacttgatcccagggctgcaggcagcagctgcgcgtgctgcccagaagagaacggcagctggcatcatgaagaaccctgttgtggatggaatagtggtgactgacattgacacaatgacaattgacccccaagtggagaaaaagatgggacaggtgctactcatagcagtagccgtctccagcgccatactgtcgcggaccgcctgggggtggggggaggctggggccctgatcacagccgcaacttccactttgtgggaaggctctccgaacaagtactggaactcctctacagccacttcactgtgtaacatttttaggggaagttacttggctggagcttctctaatctacacagtaacaagaaacgctggcttggtcaagagacgtgggggtggaacaggagagaccctgggagagaaatggaaggcccgcttgaaccagatgtcggccctggagttctactcctacaaaaagtcaggcatcaccgaggtgtgcagagaagaggcccgccgcgccctcaaggacggtgtggcaacgggaggccatgctgtgtcccgaggaagtgcaaagctgagatggttggtggagcggggatacctgcagccctatggaaaggtcattgatcttggatgtggcagagggggctggagttactacgccgccaccatccgcaaagttcaagaagtgaaaggatacacaaaaggaggccctggtcatgaagaacccgtgttggtgcaaagctatgggtggaacatagtccgtcttaagagtggggtggacgtctttcatatggcggctgagccgtgtgacacgttgctgtgtgacataggtgagtcatcatctagtcctgaagtggaagaagcacggacgctcagagtcctctccatggtgggggattggcttgaaaaaagaccaggagccttttgtataaaagtgttgtgcccatacaccagcactatgatggaaaccctggagcgactgcagcgtaggtatgggggaggactggtcagagtgccactctcccgcaactctacacatgagatgtactgggtctctggagcgaaaagcaacaccataaaaagtgtgtccaccacgagccagctcctcttggggcgcatggacgggcctaggaggccagtgaaatatgaggaggatgtgaatctcggctctggcacgcgggctgtggtaagctgcgctgaagctcccaacatgaagatcattggtaaccgcattgaaaggatccgcagtgagcacgcggaaacgtggttctttgacgagaaccacccatataggacatgggcttaccatggaagctatgaggcccccacacaagggtcagcgtcctctctaataaacggggttgtcaggctcctgtcaaaaccctgggatgtggtgactggagtcacaggaatagccatgaccgacaccacaccgtatggtcagcaaagagttttcaaggaaaaagtggacactagggtgccagacccccaagaaggcactcgtcaggttatgagcatggtctcttcctggttgtggaaagagctaggcaaacacaaacggccacgagtctgtaccaaagaagagttcatcaacaaggttcgtagcaatgcagcattaggggcaatatttgaagaggaaaaagagtggaagactgcagtggaagctgtgaacgatccaaggttctgggctctagtggacaaggaaagagagcaccacctgagaggagagtgccagagttgtgtgtacaacatgatgggaaaaagagaaaagaaacaaggggaatttggaaaggccaagggcagccgcgccatctggtatatgtggctaggggctagatttctagagttcgaagcccttggattcttgaacgaggatcactggatggggagagagaactcaggaggtggtgttgaagggctgggattacaaagactcggatatgtcctagaagagatgagtcgtataccaggaggaaggatgtatgcagatgacactgctggctgggacacccgcattagcaggtttgatctggagaatgaagctctaatcaccaaccaaatggagaaagggcacagggccttggcattggccataatcaagtacacataccaaaacaaagtggtaaaggtccttagaccagctgaaaaagggaaaacagttatggacattatttcgagacaagaccaaagggggagcggacaagttgtcacttacgctcttaacacatttaccaacctagtggtgcaactcattcggaatatggaggctgaggaagttctagagatgcaagacttgtggctgctgcggaggtcagagaaagtgactaactggttgcagagcaacggatgggataggctcaaacgaatggcagtcagtggagatgattgcgttgtgaagccaattgatgataggtttgcacatgccctcaggttcttgaatgatatgggaaaagttaggaaggacacacaagagtggaaaccctcaactggatgggacaactgggaagaagttccgttttgctcccaccacttcaacaagctccatctcaaggacgggaggtccattgtggttccctgccgccaccaagatgaactgattggccgggcccgcgtctctccaggggcgggatggagcatccgggagactgcttgcctagcaaaatcatatgcgcaaatgtggcagctcctttatttccacagaagggacctccgactgatggccaatgccatttgttcatctgtgccagttgactgggttccaactgggagaactacctggtcaatccatggaaagggagaatggatgaccactgaagacatgcttgtggtgtggaacagagtgtggattgaggagaacgaccacatggaagacaagaccccagttacgaaatggacagacattccctatttgggaaaaagggaagacttgtggtgtggatctctcatagggcacagaccgcgcaccacctgggctgagaacattaaaaacacagtcaacatggtgcgcaggatcataggtgatgaagaaaagtacatggactacctatccacccaagttcgctacttgggtgaagaagggtctacacctggagtgctgtaagcaccaatcttaatgttgtcaggcctgctagtcagccacagcttggggaaagctgtgcagcc

SEQ ID NO: 14 - protein, 3423 aa, Zika virus
  Strain BeH818995 polyprotein
MKNPKKKSGGFRIVNMLKRGVARVSPFGGLKRLPAGLLLGHGPIRMVLAILAFLRFTAIKPSLGLINRWGSVGKKEAMEIIKKFKKDLAAMLRIINARKEKKRRGADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSADVGCSVDFSKKETRCGTGVFVYNDVEAWRDRYKYHPDSPRRLAAAVKQAWEDGICGISSVSRMENIMWRSVEGELNAILEENGVQLTVVVGSVKNPMWRGPQRLPVPVNELPHGWKAWGKSYFVRAAKTNNSFVVDGDTLKECPLKHRAWNSFLVEDHGFGVFHTSVWLKVREDYSLECDPAVIGTAVKGKEAVHSDLGYWIESEKNDTWRLKRAHLIEMKTCEWPKSHTLWTDGIEESDLIIPKSLAGPLSHHNTREGYRTQMKGPWHSEELEIRFEECPGTKVHVEETCGTRGPSLRSTTASGRVIEEWCCRECTMPPLSFRAKDGCWYGMEIRPRKEPESNLVRSMVTAGSTDHMDHFSLGVLVILLMVQEGLKKRMTTKIIISTSMAVLVAMILGGFSMSDLAKLAILMGATFAEMNTGGDVAHLALIAAFKVRPALLVSFIFRANWTPRESMLLALASCLLQTAISALEGDLMVLINGFALAWLAIRAMVVPRTDNITLAILAALTPLARGTLLVAWRAGLATCGGFMLLSLKGKGSVKKNLPFVMALGLTAVRLVDPINVVGLLLLTRSGKRSWPPSEVLTAVGLICALAGGFAKADIEMAGPMAAVGLLIVSYVVSGKSVDMYIERAGDITWEKDAEVTGNSPRLDVALDESGDFSLVEDDGPPMREIILKVVLMTICGMNPIAIPFAAGAWYVYVKTGKRSGALWDVPAPKEVKKGETTDGVYRVMTRRLLGSTQVGVGVMQEGVFHTMWHVTKGSALRSGEGRLDPYWGDVKQDLVSYCGPWKLDAAWDGHSEVQLLAVPPGERARNIQTLPGIFKTKDGDIGAVALDYPAGTSGSPILDKCGRVIGLYGNGVVIKNGSYVSAITQGRREEETPVECFEPSMLKKKQLTVLDLHPGAGKTRRVLPEIVREAIKTRLRTVILAPTRVVAAEMEEALRGLPVRYMTTAVNVTHSGTEIVDLMCHATFTSRLLQPIRVPNYNLYIMDEAHFTDPSSIAARGYISTRVEMGEAAAIFMTATPPGTRDAFPDSNSPIMDTEVEVPERAWSSGFDWVTDHSGKTVWFVPSVRNGNEIAACLTKAGKRVIQLSRKTFETEFQKTKHQEWDFVVTTDISEMGANFKADRVIDSRRCLKPVILDGERVILAGPMPVTHASAAQRRGRIGRNPNKPGDEYLYGGGCAETDEDHAHWLEARMLLDNIYLQDGLIASLYRPEADKVAAIEGEFKLRTEQRKTFVELMKRGDLPVWLAYQVASAGITYTDRRWCFDGTTNNTIMEDSVPAEVWTRHGEKRVLKPRWMDARVCSDHAALKSFKEFAAGKRGAAFGVMEALGTLPGHMTERFQEAIDNLAVLMRAETGSRPYKAAAAQLPETLETIMLLGLLGTVSLGIFFVLMRNKGIGKMGFGMVTLGASAWLMWLSEIEPARIACVLIVVFLLLVVLIPEPEKQRSPQDNQMAIIIMVAVGLLGLITANELGWLERTKSDLSHLMGRREEGATIGFSMDIDLRPASAWAIYAALTTFITPAVQHAVTTSYNNYSLMAMATQAGVLFGMGKGMPFYAWDFGVPLLMIGCYSQLTPLTLIVAIILLVAHYMYLIPGLQAAAARAAQKRTAAGIMKNPVVDGIVVTDIDTMTIDPQVEKKMGQVLLIAVAVSSAILSRTAWGWGEAGALITAATSTLWEGSPNKYWNSSTATSLCNIFRGSYLAGASLIYTVTRNAGLVKRRGGGTGETLGEKWKARLNQMSALEFYSYKKSGITEVCREEARRALKDGVATGGHAVSRGSAKLRWLVERGYLQPYGKVIDLGCGRGGWSYYAATIRKVQEVKGYTKGGPGHEEPVLVQSYGWNIVRLKSGVDVFHMAAEPCDTLLCDIGESSSSPEVEEARTLRVLSMVGDWLEKRPGAFCIKVLCPYTSTMMETLERLQRRYGGGLVRVPLSRNSTHEMYWVSGAKSNTIKSVSTTSQLLLGRMDGPRRPVKYEEDVDLGSGTRAVVSCAEAPNMKIIGNRIERIRSEHAETWFFDENHPYRTWAYHGSYEAPTQGSASSLINGVVRLLSKPWDVVTGVTGIAMTDTTPYGQQRVFKEKVDTRVPDPQEGTRQVMSMVSSWLWKELGKHKRPRVCTKEEFINKVRSNAALGAIFEEEKEWKTAVEAVNDPRFWALVDKEREHHLRGECQSCVYNMMGKREKKQGEFGKAKGSRAIWYMWLGARFLEFEALGFLNEDHWMGRENSGGGVEGLGLQRLGYVLEEMSRIPGGRMYADDTAGWDTRISRFDLENEALITNQMEKGHRALALAIIKYTYQNKVVKVLRPAEKGKTVMDIISRQDQRGSGQVVTYALNTFTNLVVQLIRNMEAEEVLEMQDLWLLRRSEKVTNWLQSNGWDRLKRMAVSGDDCVVKPIDDRFAHALRFLNDMGKVRKDTQEWKPSTGWDNWEEVPFCSHHFNKLHLKDGRSIVVPCRHQDELIGRARVSPGAGWSIRETACLAKSYAQMWQLLYFHRRDLRLMANAICSSVPVDWVPTGRTTWSIHGKGEWMTTEDMLVVWNRVWIEENDHMEDKTPVTKWTDIPYLGKREDLWCGSLIGHRPRTTWAENIKNTVNMVRRIIGDEEKYMDYLSTQVRYLGEEGSTPGVL

SEQ ID NO: 15 - protein, 3423 aa, Zika virus
  Isolate SSABR1 polyprotein
MKNPKKKSGGFRIVNMLKRGVARVSPFGGLKRLPAGLLLGHGPIRMVLAILAFLRFTAIKPSLGLINRWGSVGKKEAMEIIKKFKKDLAAMLRIINARKEKKRRGADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSADVGCSVDFSKKETRCGTGVFVYNDVEAWRDRYKYHPDSPRRLAAAVKQAWEDGICGISSVSRMENIMWRSVEGELNAILEENGVQLTVVVGSVKNPMWRGPQRLPVPVNELPHGWKAWGKSYFVRAAKTNNSFVVDGDTLKECPLKHRAWNSFLVEDHGFGVFHTSVWLKVREDYSLECDPAVIGTAVKGKEAVHSDLGYWIESEKNDTWRLKRAHLIEMKTCEWPKSHTLWTDGIEESDLIIPKSLAGPLSHHNTREGYRTQMKGPWHSEELEIRFEECPGTKVHVEETCGTRGPSLRSTTASGRVIEEWCCRECTMPPLSFRAKDGCWYGMEIRPRKEPESNLVRSMVTAGSTDHMDHFSLGVLVILLMVQEGLKKRMTTKIIISTSMAVLVAMILGGFSMSDLAKLAILMGATFAEMNTGGDVAHLALIAAFKVRPALLVSFIFRANWTPRESMLLALASCLLQTAISALEGDLMVLINGFALAWLAIRAMVVPRTDNITLAILAALTPLARGTLLVAWRAGLATCGGFMLLSLKGKGSVKKNLPFVMALGLTAVRLVDPINVVGLLLLTRSGKRSWPPSEVLTAVGLICALAGGFAKADIEMAGPMAAVGLLIVSYVVSGKSVDMYIERAGDITWEKDAEVTGNSPRLDVALDESGDFSLVEDDGPPMREIILKVVLMTICGMNPIAIPFAAGAWYVYVKTGKRSGALWDVPAPKEVKKGETTDGVYRVMTRRLLGSTQVGVGVMQEGVFHTMWHVTKGSALRSGEGRLDPYWGDVKQDLVSYCGPWKLDAAWDGHSEVQLLAVPPGERARNIQTLPGIFKTKDGDIGAVALDYPAGTSGSPILDKCGRVIGLYGNGVVIKNGSYVSAITQGRREEETPVECFEPSMLKKKQLTVLDLHPGAGKTRRVLPEIVREAIKTRLRTVILAPTRVVAAEMEEALRGLPVRYMTTAVNVTHSGTEIVDLMCHATFTSRLLQPIRVPNYNLYIMDEAHFTDPSSIAARGYISTRVEMGEAAAIFMTATPPGTRDAFPDSNSPIMDTEVEVPERAWSSGFDWVTDHSGKTVWFVPSVRNGNEIAACLTKAGKRVIQLSRKTFETEFQKTKHQEWDFVVTTDISEMGANFKADRVIDSRRCLKPVILDGERVILAGPMPVTHASAAQRRGRIGRNPNKPGDEYLYGGGCAETDEDHAHWLEARMLLDNIYLQDGLIASLYRPEADKVAAIEGEFKLRTEQRKTFVELMKRGDLPVWLAYQVASAGITYTDRRWCFDGTTNNTIMEDSVPAEVWTRHGEKRVLKPRWMDARVCSDHAALKSFKEFAAGKRGAAFGVMEALGTLPGHMTERFQEAIDNLAVLMRAETGSRPYKAAAAQLPETLETIMLLGLLGTVSLGIFFVLMRNKGIGKMGFGMVTLGASAWLMWLSEIEPARIACVLIVVFLLLVVLIPEPEKQRSPQDNQMAIIIMVAVGLLGLITANELGWLERTKSDLSHLMGRREEGATIGFSMDIDLRPASAWAIYAALTTFITPAVQHAVTTSYNNYSLMAMATQAGVLFGMGKGMPFYAWDFGVPLLMIGCYSQLTPLTLIVAIILLVAHYMYLIPGLQAAAARAAQKRTAAGIMKNPVVDGIVVTDIDTMTIDPQVEKKMGQVLLIAVAVSSAILSRTAWGWGEAGALITAATSTLWEGSPNKYWNSSTATSLCNIFRGSYLAGASLIYTVTRNAGLVKRRGGGTGETLGEKWKARLNQMSALEFYSYKKSGITEVCREEARRALKDGVATGGHAVSRGSAKLRWLVERGYLQPYGKVIDLGCGRGGWSYYAATIRKVQEVKGYTKGGPGHEEPVLVQSYGWNIVRLKSGVDVFHMAAEPCDTLLCDIGESSSSPEVEEARTLRVLSMVGDWLEKRPGAFCIKVLCPYTSTMMETLERLQRRYGGGLVRVPLSRNSTHEMYWVSGAKSNTIKSVSTTSQLLLGRMDGPRRPVKYEEDVNLGSGTRAVVSCAEAPNMKIIGNRIERIRSEHAETWFFDENHPYRTWAYHGSYEAPTQGSASSLINGVVRLLSKPWDVVTGVTGIAMTDTTPYGQQRVFKEKVDTRVPDPQEGTRQVMSMVSSWLWKELGKHKRPRVCTKEEFINKVRSNAALGAIFEEEKEWKTAVEAVNDPRFWALVDKEREHHLRGECQSCVYNMMGKREKKQGEFGKAKGSRAIWYMWLGARFLEFEALGFLNEDHWMGRENSGGGVEGLGLQRLGYVLEEMSRIPGGRMYADDTAGWDTRISRFDLENEALITNQMEKGHRALALAIIKYTYQNKVVKVLRPAEKGKTVMDIISRQDQRGSGQVVTYALNTFTNLVVQLIRNMEAEEVLEMQDLWLLRRSEKVTNWLQSNGWDRLKRMAVSGDDCVVKPIDDRFAHALRFLNDMGKVRKDTQEWKPSTGWDNWEEVPFCSHHFNKLHLKDGRSIVVPCRHQDELIGRARVSPGAGWSIRETACLAKSYAQMWQLLYFHRRDLRLMANAICSSVPVDWVPTGRTTWSIHGKGEWMTTEDMLVVWNRVWIEENDHMEDKTPVTKWTDIPYLGKREDLWCGSLIGHRPRTTWAENIKNTVNMVRRIIGDEEKYMDYLSTQVRYLGEEGSTPGVL

SEQ ID NO: 16 - protein, 3423 aa, Zika virus
  Strain Natal RGN polyprotein
MKNPKKKSGGFRIVNMLKRGVARVSPFGGLKRLPAGLLLGHGPIRMVLAILAFLRFTAIKPSLGLINRWGSVGKKEAMEIIKKFKKDLAAMLRIINARKEKKRRGADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSADVGCSVDFSKKETRCGTGVFVYNDVEAWRDRYKYHPDSPRRLAAAVKQAWEDGICGISSVSRMENIMWRSVEGELNAILEENGVQLTVVVGSVKNPMWRGPQRLPVPVNELPHGWKAWGKSYFVRAAKTNNSFVVDGDTLKECPLEHRAWNSFLVEDHGFGVFHTSVWLKVREDYSLECDPAVIGTAVKGKEAVHSDLGYWIESEKNDTWRLKRAHLIEMKTCEWPKSHTLWADGIEESDLIIPKSLAGPLSHHNTREGYRTQMKGPWHSEELEIRFEECPGTKVHVEETCGTRGPSLRSTTASGRVIEEWCCRECTMPPLSFRAKDGCWYGMEIRPRKEPESNLVRSVVTAGSTDHMDHFSLGVLVILLMVQEGLKKRMTTKIIISTSMAVLVAMILGGFSMSDLAKLAILMGATFAEMNTGGDVAHLALIAAFKVRPALLVSFIFRANWTPRESMLLALASCLLQTAISALEGDLMVLINGFALAWLAIRAMVVPRTDNITLAILAALTPLARGTLLVAWRAGLATCGGFMLLSLKGKGSVKKNLPFVMALGLTAVRLVDPINVVGLLLLTRSGKRSWPPSEVLTAVGLICALAGGFAKADIEMAGPMAAVGLLIVSYVVSGKSVDMYIERAGDITWEKDAEVTGNSPRLDVALDESGDFSLVEDDGPPMREIILKVVLMTICGMNPIAIPFAAGAWYVYVKTGKRSGALWDVPAPKEVKKGETTDGVYRVMTRRLLGSTQVGVGVMQEGVFHTMWHVTKGSALRSGEGRLDPYWGDVKQDLVSYCGPWKLDAAWDGHSEVQLLAVPPGERARNIQTLPGIFKTKDGDIGAVALDYPAGTSGSPILDKCGRVIGLYGNGVVIKNGSYVSAITQGRREEETPVECFEPSMLKKKQLTVLDLHPGAGKTRRVLPEIVREAIKTRLRTVILAPTRVVAAEMEEALRGLPVRYMTTAVNVTHSGTEIVDLMCHATFTSRLLQPIRVPNYNLYIMDEAHFTDPSSIAARGYISTRVEMGEAAAIFMTATPPGTRDAFPDSNSPIMDTEVEVPERAWSSGFDWVTDHSGKTVWFVPSVRNGNEIAACLTKAGKRVIQLSRKTFETEFQKTKHQEWDFVVTTDISEMGANFKADRVIDSRRCLKPVILDGERVILAGPMPVTHASAAQRRGRIGRNPNKPGDEYLYGGGCAETDEDHAHWLEARMLLDNIYLQDGLIASLYRPEADKVAAIEGEFKLRTEQRKTFVELMKRGDLPVWLAYQVASAGITYTDRRWCFDGTTNNTIMEDSVPAEVWTRHGEKRVLKPRWMDARVCSDHAALKSFKEFAAGKRGAAFGVMEALGTLPGHMTERFQEAIDNLAVLMRAETGSRPYKAAAAQLPETLETIMLLGLLGTVSLGIFFVLMRNKGIGKMGFGMVTLGASAWLMWLSEIEPARIACVLIVVFLLLVVLIPEPEKQRSPQDNQMAIIIMVAVGLLGLITANELGWLERTKSDLSHLMGRREEGATIGFSMDIDLRPASAWAIYAALTTFITPAVQHAVTTSYNNYSLMAMATQAGVLFGMGKGMPFYAWDFGVPLLMIGCYSQLTPLTLIVAIILLVAHYMYLIPGLQAAAARAAQKRTAAGIMKNPVVDGIVVTDIDTMTIDPQVEKKMGQVLLIAVAVSSAILSRTAWGWGEAGALITAATSTLWEGSPNKYWNSSTATSLCNIFRGSYLAGASLIYIVTRNAGLVKRRGGGTGETLGEKWKARLNQMSALEFYSYKKSGITEVCREEARRALKDGVATGGHAVSRGSAKLRWLVERGYLQPYGKVIDLGCGRGGWSYYAATIRKVQEVKGYTKGGPGHEEPVLVQSYGWNIVRLKSGVDVFHMAAEPCDTLLCDIGESSSSPEVEEARTLRVLSMVGDWLEKRPGAFCIKVLCPYTSTMMETLERLQRRYGGGLVRVPLSRNSTHEMYWVSGAKSNTIKSVSTTSQLLLGRMDGPRRPVKYEEDVNLGSGTRAVVSCAEAPNMKIIGNRIERIRSEHAETWFFDENHPYRTWAYHGSYEAPTQGSASSLINGVVRLLSKPWDVVTGVTGIAMTDTTPYGQQRVFKEKVDTRVPDPQEGTRQVMSMVSSWLWKELGKHKRPRVCTKEEFINKVRSNAALGAIFEEEKEWKTAVEAVNDPRFWALVDKEREHHLRGECQSCVYNMMGKREKKQGEFGKAKGSRAIWYMWLGARFLEFEALGFLNEDHWMGRENSGGGVEGLGLQRLGYVLEEMSRIPGGRMYADDTAGWDTRISRFDLENEALITNQMEKGHRALALAIIKYTYQNKVVKVLRPAEKGKTVMDIISRQDQRGSGQVVTYALNTFTNLVVQLIRNMEAEEVLEMQDLWLLRRSEKVTNWLQSNGWDRLKRMAVSGDDCVVKPIDDRFAHALRFLNDMGKVRKDTQEWKPSTGWDNWEEVPFCSHHFNKLHLKDGRSIVVPCRHQDELIGRARVSPGAGWSIRETACLAKSYAQMWQLLYFHRRDLRLMANAICSSVPVDWVPTGRTTWSIHGKGEWMTTEDMLVVWNRVWIEENDHMEDKTPVTKWTDIPYLGKREDLWCGSLIGHRPRTTWAENIKNTVNMVRRIIGDEEKYMDYLSTQVRYLGEEGSTPGVL

SEQ ID NO: 17 - protein, 3423 aa, Zika virus
  Strain Haiti/1225/2014 polyprotein
MKNPKKKSGGFRIVNMLKRGVARVSPFGGLKRLPAGLLLGHGPIRMVLAILAFLRFTAIKPSLGLINRWGSVGKKEAMEIIKKFKKDLAAMLRIINARKEKKRRGADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSADVGCSVDFSKKETRCGTGVFVYNDVEAWRDRYKYHPDSPRRLAAAVKQAWEDGICGISSVSRMENIMWRSVEGELNAILEENGVQLTVVVGSVKNPMWRGPQRLPVPVNELPHGWKAWGKSHFVRAAKTNNSFVVDGDTLKECPLKHRAWNSFLVEDHGFGVFHTSVWLKVREDYSLECDPAVIGTAVKGKEAVHSDLGYWIESEKNDTWRLKRAHLIEMKTCEWPKSHTLWTDGIEESDLIIPKSLAGPLSHHNTREGYRTQMKGPWHSEELEIRFEECPGTKVHVEETCGTRGPSLRSTTASGRVIEEWCCRECTMPPLSFRAKDGCWYGMEIRPRKEPESNLVRSMVTAGSTDHMDHFSLGVLVILLMVQEGLKKRMTTKIIISTSMAVLVAMILGGFSMSDLAKLAILMGATFAEMNTGGDVAHLALIAAFKVRPALLVSFIFRANWTPRESMLLALASCLLQTAISALEGDLMVLINGFALAWLAIRAMVVPRTDNITLAILAALTPLARGTLLVAWRAGLATCGGFMLLSLKGKGSVKKNLPFVMALGLTAVRLVDPINVVGLLLLTRSGKRSWPPSEVLTAVGLICALAGGFAKADIEMAGPMAAVGLLIVSYVVSGKSVDMYIERAGDITWEKDAEVTGNSPRLDVALDESGDFSLVEDDGPPMREIILKVVLMTICGMNPIAIPFAAGAWYVYVKTGKRSGALWDVPAPKEVKKGETTDGVYRVMTRRLLGSTQVGVGVMQEGVFHTMWHVTKGSALRSGEGRLDPYWGDVKQDLVSYCGPWKLDAAWDGHSEVQLLAVPPGERARNIQTLPGIFKTKDGDIGAVALDYPAGTSGSPILDKCGRVIGLYGNGVVIKNGSYVSAITQGRREEETPVECFEPSMLKKKQLTVLDLHPGAGKTRRVLPEIVREAIKTRLRTVILAPTRVVAAEMEEALRGLPVRYMTTAVNVTHSGTEIVDLMCHATFTSRLLQPIRVPNYNLYIMDEAHFTDPSSIAARGYISTRVEMGEAAAIFMTATPPGTRDAFPDSNSPIMDTEVEVPERAWSSGFDWVTDYSGKTVWFVPSVRNGNEIAACLTKAGKRVIQLSRKTFETEFQKTKHQEWDFVVTTDISEMGANFKADRVIDSRRCLKPVILDGERVILAGPMPVTHASAAQRRGRIGRNPNKPGDEYLYGGGCAETDEDHAHWLEARMLLDNIYLQDGLIASLYRPEADKVAAIEGEFKLRTEQRKTFVELMKRGDLPVWLAYQVASAGITYTDRRWCFDGTTNNTIMEDSVPAEVWTRHGEKRVLKPRWMDARVCSDHAALKSFKEFAAGKRGAAFGVMEALGTLPGHMTERFQEAIDNLAVLMRAETGSRPYKAAAAQLPETLETIMLLGLLGTVSLGIFFVLMRNKGIGKMGFGMVTLGASAWLMWLSEIEPARIACVLIVVFLLLVVLIPEPEKQRSPQDNQMAIIIMVAVGLLGLITANELGWLERTKSDLSHLMGRREEGATMGFSMDIDLRPASAWAIYAALTTFITPAVQHAVTTSYNNYSLMAMATQAGVLFGMGKGMPFYAWDFGVPLLMIGCYSQLTPLTLIVAIILLVAHYMYLIPGLQAAAARAAQKRTAAGIMKNPVVDGIVVTDIDTMTIDPQVEKKMGQVLLMAVAVSSAILSRTAWGWGEAGALITAATSTLWEGSPNKYWNSSTATSLCNIFRGSYLAGASLIYTVTRNAGLVKRRGGGTGETLGEKWKARLNQMSALEFYSYKKSGITEVCREEARRALKDGVATGGHAVSRGSAKLRWLVERGYLQPYGKVIDLGCGRGGWSYYAATIRKVQEVKGYTKGGPGHEEPVLVQSYGWNIVRLKSGVDVFHMAAEPCDTLLCDIGESSSSPEVEEARTLRVLSMVGDWLEKRPGAFCIKVLCPYTSTMMETLERLQRRYGGGLVRVPLSRNSTHEMYWVSGAKSNTIKSVSTTSQLLLGRMDGPRRPVKYEEDVNLGSGTRAVVSCAEAPNMKIIGNRIERIRSEHAETWFFDENHPYRTWAYHGSYEAPTQGSASSLINGVVRLLSKPWDVVTGVTGIAMTDTTPYGQQRVFKEKVDTRVPDPQEGTRQVMSMVSSWLWKELGKHKRPRVCTKEEFINKVRSNAALGAIFEEEKEWKTAVEAVNDPRFWALVDKEREHHLRGECQSCVYNMMGKREKKQGEFGKAKGSRAIWYMWLGARFLEFEALGFLNEDHWMGRENSGGGVEGLGLQRLGYVLEEMSRIPGGRMYADDTAGWDTRISRFDLENEALITNQMEKGHRALALAIIKYTYQNKVVKVLRPAEKGKTVMDIISRQDQRGSGQVVTYALNTFTNLVVQLIRNMEAEEVLEMQDLWLLRRSEKVTNWLQSNGWDRLKRMAVSGDDCVVKPIDDRFAHALRFLNDMGKVRKDTQEWKPSTGWDNWEEVPFCSHHFNKLHLKDGRSIVVPCRHQDELIGRARVSPGAGWSIRETACLAKSYAQMWQLLYFHRRDLRLMANAICSSVPVDWVPTGRTTWSIHGKGEWMTTEDMLVVWNRVWIEENDHMEDKTPVTKWTDIPYLGKREDLWCGSLIGHRPRTTWAENIKNTVNMVRRIIGDEEKYMDYLSTQVRYLGEEGSTPGVL

SEQ ID NO: 18 - protein, 3423 aa, Zika virus
  Strain PRVABC59 polyprotein
MKNPKKKSGGFRIVNMLKRGVARVSPFGGLKRLPAGLLLGHGPIRMVLAILAFLRFTAIKPSLGLINRWGSVGKKEAMETIKKFKKDLAAMLRIINARKEKKRRGADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSADVGCSVDFSKKETRCGTGVFVYNDVEAWRDRYKYHPDSPRRLAAAVKQAWEDGICGISSVSRMENIMWRSVEGELNAILEENGVQLTVVVGSVKNPMWRGPQRLPVPVNELPHGWKAWGKSYFVRAAKTNNSFVVDGDTLKECPLKHRAWNSFLVEDHGFGVFHTSVWLKVREDYSLECDPAVIGTAVKGKEAVHSDLGYWIESEKNDTWRLKRAHLIEMKTCEWPKSHTLWTDGIEESDLIIPKSLAGPLSHHNTREGYRTQMKGPWHSEELEIRFEECPGTKVHVEETCGTRGPSLRSTTASGRVIEEWCCRECTMPPLSFRAKDGCWYGMEIRPRKEPESNLVRSMVTAGSTDHMDHFSLGVLVILLMVQEGLKKRMTTKIIISTSMAVLVAMILGGFSMSDLAKLAILMGATFAEMNTGGDVAHLALIAAFKVRPALLVSFIFRANWTPRESMLLALASCLLQTAISALEGDLMVLINGFALAWLAIRAMVVPRTDNITLAILAALTPLARGTLLVAWRAGLATCGGFMLLSLKGKGSVKKNLPFVMALGLTAVRLVDPINVVGLLLLTRSGKRSWPPSEVLTAVGLICALAGGFAKADIEMAGPMAAVGLLIVSYVVSGKSVDMYIERAGDITWEKDAEVTGNSPRLDVALDESGDFSLVEDDGPPMREIILKVVLMTICGMNPIAIPFAAGAWYVYVKTGKRSGALWDVPAPKEVKKGETTDGVYRVMTRRLLGSTQVGVGVMQEGVFHTMWHVTKGSALRSGEGRLDPYWGDVKQDLVSYCGPWKLDAAWDGHSEVQLLAVPPGERARNIQTLPGIFKTKDGDIGAVALDYPAGTSGSPILDKCGRVIGLYGNGVVIKNGSYVSAITQGRREEETPVECFEPSMLKKKQLTVLDLHPGAGKTRRVLPEIVREAIKTRLRTVILAPTRVVAAEMEEALRGLPVRYMTTAVNVTHSGTEIVDLMCHATFTSRLLQPIRVPNYNLYIMDEAHFTDPSSIAARGYISTRVEMGEAAAIFMTATPPGTRDAFPDSNSPIMDTEVEVPERAWSSGFDWVTDHSGKTVWFVPSVRNGNEIAACLTKAGKRVIQLSRKTFETEFQKTKHQEWDFVVTTDISEMGANFKADRVIDSRRCLKPVILDGERVILAGPMPVTHASAAQRRGRIGRNPNKPGDEYLYGGGCAETDEDHAHWLEARMLLDNIYLQDGLIASLYRPEADKVAAIEGEFKLRTEQRKTFVELMKRGDLPVWLAYQVASAGITYTDRRWCFDGTTNNTIMEDSVPAEVWTRHGEKRVLKPRWMDARVCSDHAALKSFKEFAAGKRGAAFGVMEALGTLPGHMTERFQEAIDNLAVLMRAETGSRPYKAAAAQLPETLETIMLLGLLGTVSLGIFFVLMRNKGIGKMGFGMVTLGASAWLMWLSEIEPARIACVLIVVFLLLVVLIPEPEKQRSPQDNQMAIIIMVAVGLLGLITANELGWLERTKSDLSHLMGRREEGATIGFSMDIDLRPASAWAIYAALTTFITPAVQHAVTTSYNNYSLMAMATQAGVLFGMGKGMPFYAWDFGVPLLMIGCYSQLTPLTLIVAIILLVAHYMYLIPGLQAAAARAAQKRTAAGIMKNPVVDGIVVTDIDTMTIDPQVEKKMGQVLLIAVAVSSAILSRTAWGWGEAGALITAATSTLWEGSPNKYWNSSTATSLCNIFRGSYLAGASLIYTVTRNAGLVKRRGGGTGETLGEKWKARLNQMSALEFYSYKKSGITEVCREEARRALKDGVATGGHAVSRGSAKLRWLVERGYLQPYGKVIDLGCGRGGWSYYVATIRKVQEVKGYTKGGPGHEEPVLVQSYGWNIVRLKSGVDVFHMAAEPCDTLLCDIGESSSSPEVEEARTLRVLSMVGDWLEKRPGAFCIKVLCPYTSTMMETLERLQRRYGGGLVRVPLSRNSTHEMYWVSGAKSNTIKSVSTTSQLLLGRMDGPRRPVKYEEDVNLGSGTRAVVSCAEAPNMKIIGNRIERIRSEHAETWFFDENHPYRTWAYHGSYEAPTQGSASSLINGVVRLLSKPWDVVTGVTGIAMTDTTPYGQQRVFKEKVDTRVPDPQEGTRQVMSMVSSWLWKELGKHKRPRVCTKEEFINKVRSNAALGAIFEEEKEWKTAVEAVNDPRFWALVDKEREHHLRGECQSCVYNMMGKREKKQGEFGKAKGSRAIWYMWLGARFLEFEALGFLNEDHWMGRENSGGGVEGLGLQRLGYVLEEMSRIPGGRMYADDTAGWDTRISRFDLENEALITNQMEKGHRALALAIIKYTYQNKVVKVLRPAEKGKTVMDIISRQDQRGSGQVVTYALNTFTNLVVQLIRNMEAEEVLEMQDLWLLRRSEKVTNWLQSNGWDRLKRMAVSGDDCVVKPIDDRFAHALRFLNDMGKVRKDTQEWKPSTGWDNWEEVPFCSHHFNKLHLKDGRSIVVPCRHQDELIGRARVSPGAGWSIRETACLAKSYAQMWQLLYFHRRDLRLMANAICSSVPVDWVPTGRTTWSIHGKGEWMTTEDMLVVWNRVWIEENDHMEDKTPVTKWTDIPYLGKREDLWCGSLIGHRPRTTWAENIKNTVNMVRRIIGDEEKYMDYLSTQVRYLGEEGSTPGVL

SEQ ID NO: 19 - protein, 3423 aa, Zika virus
  Strain MR766-NIID polyprotein
MKNPKKKSGGFRIVNMLKRGVARVNPLGGLKRLPAGLLLGHGPIRMVLAILAFLRFTAIKPSLGLINRWGSVGKKEAMEIIKKFKKDLAAMLRIINARKERKRRGADTSIGIIGLLLTTAMAAEITRRGSAYYMYLDRSDAGKAISFATTLGVNKCHVQIMDLGHMCDATMSYECPMLDEGVEPDDVDCWCNTTSTWVVYGTCHHKKGEARRSRRAVTLPSHSTRKLQTRSQTWLESREYTKHLIKVENWIFRNPGFALVAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMTVNDIGYETDENRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGKLFSGHLKCRLKMDKLRLKGVSYSLCTAAFTFTKVPAETLHGTVTVEVQYAGTDGPCKIPVQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSADVGCSVDFSKKETRCGTGVFIYNDVEAWRDRYKYHPDSPRRLAAAVKQAWEEGICGISSVSRMENIMWKSVEGELNAILEENGVQLTVVVGSVKNPMWRGPQRLPVPVNELPHGWKAWGKSYFVRAAKTNNSFVVDGDTLKECPLEHRAWNSFLVEDHGFGVFHTSVWLKVREDYSLECDPAVIGTAVKGREAAHSDLGYWIESEKNDTWRLKRAHLIEMKTCEWPKSHTLWTDGVEESDLIIPKSLAGPLSHHNTREGYRTQVKGPWHSEELEIRFEECPGTKVYVEETCGTRGPSLRSTTASGRVIEEWCCRECTMPPLSFRAKDGCWYGMEIRPRKEPESNLVRSMVTAGSTDHMDHFSLGVLVILLMVQEGLKKRMTTKIIMSTSMAVLVVMILGGFSMSDLAKLVILMGATFAEMNTGGDVAHLALVAAFKVRPALLVSFIFRANWTPRESMLLALASCLLQTAISALEGDLMVLINGFALAWLAIRAMAVPRTDNIALPILAALTPLARGTLLVAWRAGLATCGGIMLLSLKGKGSVKKNLPFVMALGLTAVRVVDPINVVGLLLLTRSGKRSWPPSEVLTAVGLICALAGGFAKADIEMAGPMAAVGLLIVSYVVSGKSVDMYIERAGDITWEKDAEVTGNSPRLDVALDESGDFSLVEEDGPPMREIILKVVLMAICGMNPIAIPFAAGAWYVYVKTGKRSGALWDVPAPKEVKKGETTDGVYRVMTRRLLGSTQVGVGVMQEGVFHTMWHVTKGAALRSGEGRLDPYWGDVKQDLVSYCGPWKLDAAWDGLSEVQLLAVPPGERARNIQTLPGIFKTKDGDIGAVALDYPAGTSGSPILDKCGRVIGLYGNGVVIKNGSYVSAITQGKREEETPVECFEPSMLKKKQLTVLDLHPGAGKTRRVLPEIVREAIKKRLRTVILAPTRVVAAEMEEALRGLPVRYMTTAVNVTHSGTEIVDLMCHATFTSRLLQPIRVPNYNLYIMDEAHFTDPSSIAARGYISTRVEMGEAAAIFMTATPPGTRDAFPDSNSPIMDTEVEVPERAWSSGFDWVTDHSGKTVWFVPSVRNGNEIAACLTKAGKRVIQLSRKTFETEFQKTKNQEWDFVITTDISEMGANFKADRVIDSRRCLKPVILDGERVILAGPMPVTHASAAQRRGRIGRNPNKPGDEYMYGGGCAETDEGHAHWLEARMLLDNIYLQDGLIASLYRPEADKVAAIEGEFKLRTEQRKTFVELMKRGDLPVWLAYQVASAGITYTDRRWCFDGTTNNTIMEDSVPAEVWTKYGEKRVLKPRWMDARVCSDHAALKSFKEFAAGKRGAALGVMEALGTLPGHMTERFQEAIDNLAVLMRAETGSRPYKAAAAQLPETLETIMLLGLLGTVSLGIFFVLMRNKGIGKMGFGMVTLGASAWLMWLSEIEPARIACVLIVVFLLLVVLIPEPEKQRSPQDNQMAIIIMVAVGLLGLITANELGWLERTKNDIAHLMGRREEGATMGFSMDIDLRPASAWAIYAALTTLITPAVQHAVTTSYNNYSLMAMATQAGVLFGMGKGMPFYAWDLGVPLLMMGCYSQLTPLTLIVAIILLVAHYMYLIPGLQAAAARAAQKRTAAGIMKNPVVDGIVVTDIDTMTIDPQVEKKMGQVLLIAVAISSAVLLRTAWGWGEAGALITAATSTLWEGSPNKYWNSSTATSLCNIFRGSYLAGASLIYTVTRNAGLVKRRGGGTGETLGEKWKARLNQMSALEFYSYKKSGITEVCREEARRALKDGVATGGHAVSRGSAKLRWLVERGYLQPYGKVVDLGCGRGGWSYYAATIRKVQEVRGYTKGGPGHEEPMLVQSYGWNIVRLKSGVDVFHMAAEPCDTLLCDIGESSSSPEVEETRTLRVLSMVGDWLEKRPGAFCIKVLCPYTSTMMETMERLQRRHGGGLVRVPLSRNSTHEMYWVSGAKSNIIKSVSTTSQLLLGRMDGPRRPVKYEEDVNLGSGTRAVASCAEAPNMKIIGRRIERIRNEHAETWFLDENHPYRTWAYHGSYEAPTQGSASSLVNGVVRLLSKPWDVVTGVTGIAMTDTTPYGQQRVFKEKVDTRVPDPQEGTRQVMNIVSSWLWKELGKRKRPRVCTKEEFINKVRSNAALGAIFEEEKEWKTAVEAVNDPRFWALVDREREHHLRGECHSCVYNMMGKREKKQGEFGKAKGSRAIWYMWLGARFLEFEALGFLNEDHWMGRENSGGGVEGLGLQRLGYILEEMNRAPGGKMYADDTAGWDTRISKFDLENEALITNQMEEGHRTLALAVIKYTYQNKVVKVLRPAEGGKTVMDIISRQDQRGSGQVVTYALNTFTNLVVQLIRNMEAEEVLEMQDLWLLRKPEKVTRWLQSNGWDRLKRMAVSGDDCVVKPIDDRFAHALRFLNDMGKVRKDTQEWKPSTGWSNWEEVPFCSHHFNKLYLKDGRSIVVPCRHQDELIGRARVSPGAGWSIRETACLAKSYAQMWQLLYFHRRDLRLMANAICSAVPVDWVPTGRTTWSIHGKGEWMTTEDMLMVWNRVWIEENDHMEDKTPVTKWTDIPYLGKREDLWCGSLIGHRPRTTWAENIKDTVNMVRRIIGDEEKYMDYLSTQVRYLGEEGSTPGVL

SEQ ID NO: 20 - protein, 3419 aa, Zika virus
  NC_012532.1 polyprotein
MKNPKEEIRRIRIVNMLKRGVARVNPLGGLKRLPAGLLLGHGPIRMVLAILAFLRFTAIKPSLGLINRWGSVGKKEAMEIIKKFKKDLAAMLRIINARKERKRRGADTSIGIIGLLLTTAMAAEITRRGSAYYMYLDRSDAGKAISFATTLGVNKCHVQIMDLGHMCDATMSYECPMLDEGVEPDDVDCWCNTTSTWVVYGTCHHKKGEARRSRRAVTLPSHSTRKLQTRSQTWLESREYTKHLIKVENWIFRNPGFALVAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIGYETDEDRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQYAGTDGPCKIPVQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSADVGCSVDFSKKETRCGTGVFIYNDVEAWRDRYKYHPDSPRRLAAAVKQAWEEGICGISSVSRMENIMWKSVEGELNAILEENGVQLTVVVGSVKNPMWRGPQRLPVPVNELPHGWKAWGKSYFVRAAKTNNSFVVDGDTLKECPLEHRAWNSFLVEDHGFGVFHTSVWLKVREDYSLECDPAVIGTAVKGREAAHSDLGYWIESEKNDTWRLKRAHLIEMKTCEWPKSHTLWTDGVEESDLIIPKSLAGPLSHHNTREGYRTQVKGPWHSEELEIRFEECPGTKVYVEETCGTRGPSLRSTTASGRVIEEWCCRECTMPPLSFRAKDGCWYGMEIRPRKEPESNLVRSMVTAGSTDHMDHFSLGVLVILLMVQEGLKKRMTTKIIMSTSMAVLVVMILGGFSMSDLAKLVILMGATFAEMNTGGDVAHLALVAAFKVRPALLVSFIFRANWTPRESMLLALASCLLQTAISALEGDLMVLINGFALAWLAIRAMAVPRTDNIALPILAALTPLARGTLLVAWRAGLATCGGIMLLSLKGKGSVKKNLPFVMALGLTAVRVVDPINVVGLLLLTRSGKRSWPPSEVLTAVGLICALAGGFAKADIEMAGPMAAVGLLIVSYVVSGKSVDMYIERAGDITWEKDAEVTGNSPRLDVALDESGDFSLVEEDGPPMREIILKVVLMAICGMNPIAIPFAAGAWYVYVKTGKRSGALWDVPAPKEVKKGETTDGVYRVMTRRLLGSTQVGVGVMQEGVFHTMWHVTKGAALRSGEGRLDPYWGDVKQDLVSYCGPWKLDAAWDGLSEVQLLAVPPGERARNIQTLPGIFKTKDGDIGAVALDYPAGTSGSPILDKCGRVIGLYGNGVVIKNGSYVSAITQGKREEETPVECFEPSMLKKKQLTVLDLHPGAGKTRRVLPEIVREAIKKRLRTVILAPTRVVAAEMEEALRGLPVRYMTTAVNVTHSGTEIVDLMCHATFTSRLLQPIRVPNYNLNIMDEAHFTDPSSIAARGYISTRVEMGEAAAIFMTATPPGTRDAFPDSNSPIMDTEVEVPERAWSSGFDWVTDHSGKTVWFVPSVRNGNEIAACLTKAGKRVIQLSRKTFETEFQKTKNQEWDFVITTDISEMGANFKADRVIDSRRCLKPVILDGERVILAGPMPVTHASAAQRRGRIGRNPNKPGDEYMYGGGCAETDEGHAHWLEARMLLDNIYLQDGLIASLYRPEADKVAAIEGEFKLRTEQRKTFVELMKRGDLPVWLAYQVASAGITYTDRRWCFDGTTNNTIMEDSVPAEVWTKYGEKRVLKPRWMDARVCSDHAALKSFKEFAAGKRGAALGVMEALGTLPGHMTERFQEAIDNLAVLMRAETGSRPYKAAAAQLPETLETIMLLGLLGTVSLGIFFVLMRNKGIGKMGFGMVTLGASAWLMWLSEIEPARIACVLIVVFLLLVVLIPEPEKQRSPQDNQMAIIIMVAVGLLGLITANELGWLERTKNDIAHLMGRREEGATMGFSMDIDLRPASAWAIYAALTTLITPAVQHAVTTSYNNYSLMAMATQAGVLFGMGKGMPFMHGDLGVPLLMMGCYSQLTPLTLIVAIILLVAHYMYLIPGLQAAAARAAQKRTAAGIMKNPVVDGIVVTDIDTMTIDPQVEKKMGQVLLIAVAISSAVLLRTAWGWGEAGALITAATSTLWEGSPNKYWNSSTATSLCNIFRGSYLAGASLIYTVTRNAGLVKRRGGGTGETLGEKWKARLNQMSALEFYSYKKSGITEVCREEARRALKDGVATGGHAVSRGSAKIRWLEERGYLQPYGKVVDLGCGRGGWSYYAATIRKVQEVRGYTKGGPGHEEPMLVQSYGWNIVRLKSGVDVFHMAAEPCDTLLCDIGESSSSPEVEETRTLRVLSMVGDWLEKRPGAFCIKVLCPYTSTMMETMERLQRRHGGGLVRVPLCRNSTHEMYWVSGAKSNIIKSVSTTSQLLLGRMDGPRRPVKYEEDVNLGSGTRAVASCAEAPNMKIIGRRIERIRNEHAETWFLDENHPYRTWAYHGSYEAPTQGSASSLVNGVVRLLSKPWDVVTGVTGIAMTDTTPYGQQRVFKEKVDTRVPDPQEGTRQVMNIVSSWLWKELGKRKRPRVCTKEEFINKVRSNAALGAIFEEEKEWKTAVEAVNDPRFWALVDREREHHLRGECHSCVYNMMGKREKKQGEFGKAKGSRAIWYMWLGARFLEFEALGFLNEDHWMGRENSGGGVEGLGLQRLGYILEEMNRAPGGKMYADDTAGWDTRISKFDLENEALITNQMEEGHRTLALAVIKYTYQNKVVKVLRPAEGGKTVMDIISRQDQRGSGQVVTYALNTFTNLVVQLIRNMEAEEVLEMQDLWLLRKPEKVTRWLQSNGWDRLKRMAVSGDDCVVKPIDDRFAHALRFLNDMGKVRKDTQEWKPSTGWSNWEEVPFCSHHFNKLYLKDGRSIVVPCRHQDELIGRARVSPGAGWSIRETACLAKSYAQMWQLLYFHRRDLRLMANAICSAVPVDWVPTGRTTWSIHGKGEWMTTEDMLMVWNRVWIEENDHMEDKTPVTKWTDIPYLGKREDLWCGSLIGHRPRTTWAENIKDTVNMVRRIIGDEEKYMDYLSTQVRYLGEEGSTPGVL

SEQ ID NO: 21 - protein, 3423 aa, Zika virus
  Strain ZikaSPH2015 polyprotein
MKNPKKKSGGFRIVNMLKRGVARVSPFGGLKRLPAGLLLGHGPIRMVLAILAFLRFTAIKPSLGLINRWGSVGKKEAMEIIKKFKKDLAAMLRIINARKEKKRRGADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSADVGCSVDFSKKETRCGTGVFVYNDVEAWRDRYKYHPDSPRRLAAAVKQAWEDGICGISSVSRMENIMWRSVEGELNAILEENGVQLTVVVGSVKNPMWRGPQRLPVPVNELPHGWKAWGKSHFVRAAKTNNSFVVDGDTLKECPLKHRAWNSFLVEDHGFGVFHTSVWLKVREDYSLECDPAVIGTAVKGKEAVHSDLGYWIESEKNDTWRLKRAHLIEMKTCEWPKSHTLWTDGIEESDLIIPKSLAGPLSHHNTREGYRTQMKGPWHSEELEIRFEECPGTKVHVEETCGTRGPSLRSTTASGRVIEEWCCRECTMPPLSFRAKDGCWYGMEIRPRKEPESNLVRSMVTAGSTDHMDHFSLGVLVILLMVQEGLKKRMTTKIIISTSMAVLVAMILGGFSMSDLAKLAILMGATFAEMNTGGDVAHLALIAAFKVRPALLVSFIFRANWTPRESMLLALASCLLQTAISALEGDLMVLINGFALAWLAIRAMVVPRTDNITLAILAALTPLARGTLLVAWRAGLATCGGFMLLSLKGKGSVKKNLPFVMALGLTAVRLVDPINVVGLLLLTRSGKRSWPPSEVLTAVGLICALAGGFAKADIEMAGPMAAVGLLIVSYVVSGKSVDMYIERAGDITWEKDAEVTGNSPRLDVALDESGDFSLVEDDGPPMREIILKVVLMTICGMNPIAIPFAAGAWYVYVKTGKRSGALWDVPAPKEVKKGETTDGVYRVMTRRLLGSTQVGVGVMQEGVFHTMWHVTKGSALRSGEGRLDPYWGDVKQDLVSYCGPWKLDAAWDGHSEVQLLAVPPGERARNIQTLPGIFKTKDGDIGAVALDYPAGTSGSPILDKCGRVIGLYGNGVVIKNGSYVSAITQGRREEETPVECFEPSMLKKKQLTVLDLHPGAGKTRRVLPEIVREAIKTRLRTVILAPTRVVAAEMEEALRGLPVRYMTTAVNVTHSGTEIVDLMCHATFTSRLLQPIRVPNYNLYIMDEAHFTDPSSIAARGYISTRVEMGEAAAIFMTATPPGTRDAFPDSNSPIMDTEVEVPERAWSSGFDWVTDYSGKTVWFVPSVRNGNEIAACLTKAGKRVIQLSRKTFETEFQKTKHQEWDFVVTTDISEMGANFKADRVIDSRRCLKPVILDGERVILAGPMPVTHASAAQRRGRIGRNPNKPGDEYLYGGGCAETDEDHAHWLEARMLLDNIYLQDGLIASLYRPEADKVAAIEGEFKLRTEQRKTFVELMKRGDLPVWLAYQVASAGITYTDRRWCFDGTTNNTIMEDSVPAEVWTRHGEKRVLKPRWMDARVCSDHAALKSFKEFAAGKRGAAFGVMEALGTLPGHMTERFQEAIDNLAVLMRAETGSRPYKAAAAQLPETLETIMLLGLLGTVSLGIFFVLMRNKGIGKMGFGMVTLGASAWLMWLSEIEPARIACVLIVVFLLLVVLIPEPEKQRSPQDNQMAIIIMVAVGLLGLITANELGWLERTKSDLSHLMGRREEGATMGFSMDIDLRPASAWAIYAALTTFITPAVQHAVTTSYNNYSLMAMATQAGVLFGMGKGMPFYAWDFGVPLLMIGCYSQLTPLTLIVAIILLVAHYMYLIPGLQAAAARAAQKRTAAGIMKNPVVDGIVVTDIDTMTIDPQVEKKMGQVLLMAVAVSSAILSRTAWGWGEAGALITAATSTLWEGSPNKYWNSSTATSLCNIFRGSYLAGASLIYTVTRNAGLVKRRGGGTGETLGEKWKARLNQMSALEFYSYKKSGITEVCREEARRALKDGVATGGHAVSRGSAKLRWLVERGYLQPYGKVIDLGCGRGGWSYYAATIRKVQEVKGYTKGGPGHEEPVLVQSYGWNIVRLKSGVDVFHMAAEPCDTLLCDIGESSSSPEVEEARTLRVLSMVGDWLEKRPGAFCIKVLCPYTSTMMETLERLQRRYGGGLVRVPLSRNSTHEMYWVSGAKSNTIKSVSTTSQLLLGRMDGPRRPVKYEEDVNLGSGTRAVVSCAEAPNMKIIGNRIERIRSEHAETWFFDENHPYRTWAYHGSYEAPTQGSASSLINGVVRLLSKPWDVVTGVTGIAMTDTTPYGQQRVFKEKVDTRVPDPQEGTRQVMSMVSSWLWKELGKHKRPRVCTKEEFINKVRSNAALGAIFEEEKEWKTAVEAVNDPRFWALVDKEREHHLRGECQSCVYNMMGKREKKQGEFGKAKGSRAIWYMWLGARFLEFEALGFLNEDHWMGRENSGGGVEGLGLQRLGYVLEEMSRIPGGRMYADDTAGWDTRISRFDLENEALITNQMEKGHRALALAIIKYTYQNKVVKVLRPAEKGKTVMDIISRQDQRGSGQVVTYALNTFTNLVVQLIRNMEAEEVLEMQDLWLLRRSEKVTNWLQSNGWDRLKRMAVSGDDCVVKPIDDRFAHALRFLNDMGKVRKDTQEWKPSTGWDNWEEVPFCSHHFNKLHLKDGRSIVVPCRHQDELIGRARVSPGAGWSIRETACLAKSYAQMWQLLYFHRRDLRLMANAICSSVPVDWVPTGRTTWSIHGKGEWMTTEDMLVVWNRVWIEENDHMEDKTPVTKWTDIPYLGKREDLWCGSLIGHRPRTTWAENIKNTVNMVRRIIGDEEKYMDYLSTQVRYLGEEGSTPGVL

SEQ ID NO: 22 - protein, 3419 aa, Zika virus; identical to SEQ ID NO: 20
  Strain MR 766 polyprotein

SEQ ID NO: 23 - protein, 3423 aa, Zika virus; identical to SEQ ID NO: 14
  Strain BeH815744 polyprotein

SEQ ID NO: 24 - protein, 3423 aa, Zika virus; identical to SEQ ID NO: 15
  Strain BeH819966 polyprotein

SEQ ID NO: 25 - protein, 3423 aa, Zika virus; identical to SEQ ID NO: 15
  Strain BeH819015 polyprotein

SEQ ID NO: 26 - protein, 3423 aa, Zika virus
  Isolate Z1106033 polyprotein
MKNPKKKSGGFRIVNMLKRGVARVSPFGGLKRLPAGLLLGHGPIRMVLAILAFLRFTAIKPSLGLINRWGSVGKKEAMEIIKKFKKDLAAMLRIINARKEKKRRGADTSVGIVGLLLTTAMAAEVTRRGSAYYMYLDRNDAGEAISFPTTLGMNKCYIQIMDLGHTCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNAKNGSISLMCLALGGVLIFLSTAVSADVGCSVDFSKKETRCGTGVFVYNDVEAWRDRYKYHPDSPRRLAAAVKQAWEDGICGISSVSRMENIMWRSVEGELNAILEENGVQLTVVVGSVKNPMWRGPQRLPVPVNELPHGWKAWGKSYFVRAAKTNNSFVVDGDTLKECPLKHRAWNSFLVEDHGFGVFHTSVWLKVREDYSLECDPAVIGTAVKGKEAVHSDLGYWIESEKNDTWRLKRAHLIEMKTCEWPKSHTLWTDGIEESDLIIPKSLAGPLSHHNTREGYRTQMKGPWHSEELEIRFEECPGTKVHVEETCGTRGPSLRSTTASGRVIEEWCCRECTMPPLSFRAKDGCWYGMEIRPRKEPESNLVRSMVTAGSTDHMDHFSLGVLVILLMVQEGLKKRMTTKIIISTSMAVLVAMILGGFSMSDLAKLAILMGATFAEMNTGGDVAHLALIAAFKVRPALLVSFIFRANWTPRESMLLALASCLLQTAISALEGDLMVLINGFALAWLAIRAMVVPRTDNITLAILAALTPLARGTLLVAWRAGLATCGGFMLLSLKGKGSVKKNLPFVMALGLTAVRLVDPINVVGLLLLTRSGKRSWPPSEVLTAVGLICALAGGFAKADIEMAGPMAAVGLLIVSYVVSGKSVDMYIERAGDITWEKDAEVTGNSPRLDVALDESGDFSLVEDDGPPMREIILKVVLMTICGMNPIAIPFAAGAWYVYVKTGKRSGALWDVPAPKEVKKGETTDGVYRVMTRRLLGSTQVGVGVMQEGVFHTMWHVTKGSALRSGEGRLDPYWGDVKQDLVSYCGPWKLDAAWDGHSEVQLLAVPPGERARNIQTLPGIFKTKDGDIGAVALDYPAGTSGSPILDKCGRVIGLYGNGVVIKNGSYVSAITQGRREEETPVECFEPSMLKKKQLTVLDLHPGAGKTRRVLPEIVREAIKTRLRTVILAPTRVVAAEMEEALRGLPVRYMTTAVNVTHSGTEIVDLMCHATFTSRLLQPIRVPNYNLYIMDEAHFTDPSSIAARGYISTRVEMGEAAAIFMTATPPGTRDAFPDSNSPIMDTEVEVPERAWSSGFDWVTDHSGKTVWFVPSVRNGNEIAACLTKAGKRVIQLSRKTFETEFQKTKHQEWDFVVTTDISEMGANFKADRVIDSRRCLKPVILDGERVILAGPMPVTHASAAQRRGRIGRNPNKPGDEYLYGGGCAETDEDHAHWLEARMLLDNIYLQDGLIASLYRPEADKVAAIEGEFKLRTEQRKTFVELMKRGDLPVWLAYQVASAGITYTDRRWCFDGTTNNTIMEDSVPAEVWTRHGEKRVLKPRWMDARVCSDHAALKSFKEFAAGKRGAAFGVMEALGTLPGHMTERFQEAIDNLAVLMRAETGSRPYKAAAAQLPETLETIMLLGLLGTVSLGIFFVLMRNKGIGKMGFGMVTLGASAWLMWLSEIEPARIACVLIVVFLLLVVLIPEPEKQRSPQDNQMAIIIMVAVGLLGLITANELGWLERTKSDLSHLMGRREEGATIGFSMDIDLRPASAWAIYAALTTFITPAVQHAVTTSYNNYSLMAMATQAGVLFGMGKGMPFYAWDFGVPLLMIGCYSQLTPLTLIVAIILLVAHYMYLIPGLQAAAARAAQKRTAAGIMKNPVVDGIVVTDIDTMTIDPQVEKKMGQVLLIAVAVSSAILSRTAWGWGEAGALITAATSTLWEGSPNKYWNSSTATSLCNIFRGSYLAGASLIYTVTRNAGLVKRRGGGTGETLGEKWKARLNQMSALEFYSYKKSGITEVCREEARRALKDGVATGGHAVSRGSAKLRWLVERGYLQPYGKVIDLGCGRGGWSYYAATIRKVQEVKGYTKGGPGHEEPVLVQSYGWNIVRLKSGVDVFHMAAEPCDTLLCDIGESSSSPEVEEARTLRVLSMVGDWLEKRPGAFCIKVLCPYTSTMMETLERLQRRYGGGLVRVPLSRNSTHEMYWVSGAKSNTIKSVSTTSQLLLGRMDGPRRPVKYEEDVNLGSGTRAVVSCAEAPNMKIIGNRIERIRSEHAETWFFDENHPYRTWAYHGSYEAPTQGSASSLINGVVRLLSKPWDVVTGVTGIAMTDTTPYGQQRVFKEKVDTRVPDPQEGTRQVMSMVSSWLWKELGKHKRPRVCTKEEFINKVRSNAALGAIFEEEKEWKTAVEAVNDPRFWALVDKEREHHLRGECQSCVYNMMGKREKKQGEFGKAKGSRAIWYMWLGARFLEFEALGFLNEDHWMGRENSGGGVEGLGLQRLGYVLEEMSRIPGGRMYADDTAGWDTRISRFDLENEALITNQMEKGHRALALAIIKYTYQNKVVKVLRPAEKGKTVMDIISRQDQRGSGQVVTYALNTFTNLVVQLIRNMEAEEVLEMQDLWLLRRSEKVTNWLQSNGWDRLKRMAVSGDDCVVKPIDDRFAHALRFLNDMGKVRKDTQEWKPSTGWDNWEEVPFCSHHFNKLHLKDGRSIVVPCRHQDELIGRARVSPGAGWSIRETACLAKSYAQMWQLLYFHRRDLRLMANAICSSVPVDWVPTGRTTWSIHGKGEWMTTEDMLVVWNRVWIEENDHMEDKTPVTKWTDIPYLGKREDLWCGSLIGHRPRTTWAENIKNTVNMVRRIIGDEEKYMDYLSTQVRYLGEEGSTPGVL

SEQ ID NO: 27 - protein, 403 aa, Zika virus
  sE of SEQ ID NO:1/14
IRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRS

SEQ ID NO: 28 - protein, 403 aa, Zika virus; identical to SEQ ID NO: 27
  sE of SEQ ID NO:2/15

SEQ ID NO: 29 - protein, 403 aa, Zika virus; identical to SEQ ID NO: 27
  sE of SEQ ID NO:3/16

SEQ ID NO: 30 - protein, 403 aa, Zika virus; identical to SEQ ID NO: 27
  sE of SEQ ID NO:4/17

SEQ ID NO: 31 - protein, 403 aa, Zika virus; identical to SEQ ID NO: 27
  sE of SEQ ID NO:5/18

SEQ ID NO: 32 - protein, 403 aa, Zika virus
  sE of SEQ ID NO:6/19
IRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMTVNDIGYETDENRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGKLFSGHLKCRLKMDKLRLKGVSYSLCTAAFTFTKVPAETLHGTVTVEVQYAGTDGPCKIPVQMAVDMQTLTPVGRLITANPVITESTENSKMMLELDPPFGDSYIVIGVGDKKITHHWHRS

SEQ ID NO: 33 - protein, 399 aa, Zika virus
  sE of SEQ ID NO:7/20
IRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIGYETDEDRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQYAGTDGPCKIPVQMAVDMQTLTPVGRLITANPVITESTENSKMMLELDPPFGDSYIVIGVGDKKITHHWHRS

SEQ ID NO: 34 - protein, 403 aa, Zika virus
  sE of SEQ ID NO:8/21
IRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRS

SEQ ID NO: 35 - protein, 399 aa, Zika virus; identical to SEQ ID NO: 33
  sE of SEQ ID NO:9/22

SEQ ID NO: 36 - protein, 403 aa, Zika virus; identical to SEQ ID NO: 27
  sE of SEQ ID NO:10/23

SEQ ID NO: 37 - protein, 403 aa, Zika virus; identical to SEQ ID NO: 27
  sE of SEQ ID NO:11/24

SEQ ID NO: 38 - protein, 403 aa, Zika virus; identical to SEQ ID NO: 27
  sE of SEQ ID NO:12/25

SEQ ID NO: 39 - protein, 403 aa, Zika virus; identical to SEQ ID NO: 27
  sE of SEQ ID NO:13/26

SEQ ID NO: 40 - protein, 504 aa, Artificial sequence
  E protein + stem-anchor of SEQ ID NO:1/14
IRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 41 - protein, 504 aa, Artificial sequence; identical to SEQ ID NO: 40
  E protein + stem-anchor of SEQ ID NO:2/15

SEQ ID NO: 42 - protein, 504 aa, Artificial sequence; identical to SEQ ID NO: 40
  E protein + stem-anchor of SEQ ID NO:3/16

SEQ ID NO: 43 - protein, 504 aa, Artificial sequence; identical to SEQ ID NO: 40
  E protein + stem-anchor of SEQ ID NO:4/17

SEQ ID NO: 44 - protein, 504 aa, Artificial sequence; identical to SEQ ID NO: 40
  E protein + stem-anchor of SEQ ID NO:5/18

SEQ ID NO: 45 - protein, 504 aa, Artificial sequence
  E protein + stem-anchor of SEQ ID NO:6/19
IRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMTVNDIGYETDENRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGKLFSGHLKCRLKMDKLRLKGVSYSLCTAAFTFTKVPAETLHGTVTVEVQYAGTDGPCKIPVQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSA

SEQ ID NO: 46 - protein, 500 aa, Artificial sequence
  E protein + stem-anchor of SEQ ID NO:7/20
IRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIGYETDEDRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQYAGTDGPCKIPVQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSA

SEQ ID NO: 47 - protein, 504 aa, Artificial sequence
  E protein + stem-anchor of SEQ ID NO:8/21
IRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 48 - protein, 500 aa, Artificial sequence; identical to SEQ ID NO: 46
  E protein + stem-anchor of SEQ ID NO:9/22

SEQ ID NO: 49 - protein, 504 aa, Artificial sequence; identical to SEQ ID NO: 40
  E protein + stem-anchor of SEQ ID NO:10/23

SEQ ID NO: 50 - protein, 504 aa, Artificial sequence; identical to SEQ ID NO: 40
  E protein + stem-anchor of SEQ ID NO:11/24

SEQ ID NO: 51 - protein, 504 aa, Artificial sequence; identical to SEQ ID NO: 40
  E protein + stem-anchor of SEQ ID NO:12/25

SEQ ID NO: 52 - protein, 504 aa, Artificial sequence
  E protein + stem-anchor of SEQ ID NO:13/26
IRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNAKNGSISLMCLALGGVLIFLSTAVSA

SEQ ID NO: 53 - DNA, 1773 bp, Artificial sequence
  Insert sE no codon optimization
agacgaggcgcagatactagtgtcggaattgttggcctcctgctgaccacagctatggcagcggaggtcactagacgtgggagtgcatactatatgtacttggacagaaacgatgctggggaggccatatcttttccaaccacattggggatgaataagtgttatatacagatcatggatcttggacacatgtgtgatgccaccatgagctatgaatgccctatgctggatgagggggtggaaccagatgacgtcgattgttggtgcaacacgacgtcaacttgggttgtgtacggaacctgccatcacaaaaaaggtgaagcacggagatctagaagagctgtgacgctcccctcccattccactaggaagctgcaaacgcggtcgcaaacctggttggaatcaagagaatacacaaagcacttgattagagtcgaaaattggatatttaggaaccctggcttcgcgttagcagcagctgccatcgcttggcttttgggaagctcaacgagccaaaaagtcatatacttggtcatgatactgctgattgccccggcatacagcatcaggtgcataggagtcagcaatagggactttgtggaaggtatgtcaggtgggacctgggttgatgttgtcttggaacatggaggttgtgtcaccgtaatggcacaggacaaaccgactgtcgacatagagctggttacaacaacagtcagcaacatggcggaggtaagatcctactgctatgaggcatcaatatcagacatggcttcggacagccgctgcccaacacaaggtgaagcctaccttgacaagcaatcagacactcaatatgtctgcaaaagaacgttagtggacagaggctggggaaatggatgtggactttttggcaaagggagcctggtgacatgcgctaagtttgcatgctccaagaaaatgaccgggaagagcatccagccagagaatctggagtaccggataatgctgtcagttcatggctcccagcacagtgggatgattgttaatgacacaggacatgaaactgatgagaatagagcgaaagttgagataacgcccaattcaccaagagccgaagccaccctggggggttttggaagcctaggacttgattgtgaaccgaggacaggccttgacttttcagatttgtattacttgactatgaataacaagcactggttggttcacaaggagtggttccacgacattccattaccttggcacgctggggcagacaccggaactccacactggaacaacaaagaagcactggtagagttcaaggacgcacatgccaaaaggcaaactgtcgtggttctagggagtcaagaaggagcagttcacacggcccttgctggagctctggaggctgagatggatggtgcaaagggaaggctgtcctctggccacttgaaatgtcgcctgaaaatggataaacttagattgaagggcgtgtcatactccttgtgtactgcagcgttcacattcaccaagatcccggctgaaacactgcacgggacagtcacagtggaggtacagtacgcagggacagatggaccttgcaaggttccagctcagatggcggtggacatgcaaactctgaccccagttgggaggttgataaccgctaaccccgtaatcactgaaagcactgagaactctaagatgatgctggaacttgatccaccatttggggactcttacattgtcataggagtcggggagaagaagatcacccaccactggcacaggagt

SEQ ID NO: 54 - DNA, 2076 bp, Artificial sequence
  Insert RSP no codon optimization L107D
agacgaggcgcagatactagtgtcggaattgttggcctcctgctgaccacagctatggcagcggaggtcactagacgtgggagtgcatactatatgtacttggacagaaacgatgctggggaggccatatcttttccaaccacattggggatgaataagtgttatatacagatcatggatcttggacacatgtgtgatgccaccatgagctatgaatgccctatgctggatgagggggtggaaccagatgacgtcgattgttggtgcaacacgacgtcaacttgggttgtgtacggaacctgccatcacaaaaaaggtgaagcacggagatctagaagagctgtgacgctcccctcccattccactaggaagctgcaaacgcggtcgcaaacctggttggaatcaagagaatacacaaagcacttgattagagtcgaaaattggatatttaggaaccctggcttcgcgttagcagcagctgccatcgcttggcttttgggaagctcaacgagccaaaaagtcatatacttggtcatgatactgctgattgccccggcatacagcatcaggtgcataggagtcagcaatagggactttgtggaaggtatgtcaggtgggacctgggttgatgttgtcttggaacatggaggttgtgtcaccgtaatggcacaggacaaaccgactgtcgacatagagctggttacaacaacagtcagcaacatggcggaggtaagatcctactgctatgaggcatcaatatcagacatggcttcggacagccgctgcccaacacaaggtgaagcctaccttgacaagcaatcagacactcaatatgtctgcaaaagaacgttagtggacagaggctggggaaatggatgtggagactttggcaaagggagcctggtgacatgcgctaagtttgcatgctccaagaaaatgaccgggaagagcatccagccagagaatctggagtaccggataatgctgtcagttcatggctcccagcacagtgggatgattgttaatgacacaggacatgaaactgatgagaatagagcgaaagttgagataacgcccaattcaccaagagccgaagccaccctggggggttttggaagcctaggacttgattgtgaaccgaggacaggccttgacttttcagatttgtattacttgactatgaataacaagcactggttggttcacaaggagtggttccacgacattccattaccttggcacgctggggcagacaccggaactccacactggaacaacaaagaagcactggtagagttcaaggacgcacatgccaaaaggcaaactgtcgtggttctagggagtcaagaaggagcagttcacacggcccttgctggagctctggaggctgagatggatggtgcaaagggaaggctgtcctctggccacttgaaatgtcgcctgaaaatggataaacttagattgaagggcgtgtcatactccttgtgtactgcagcgttcacattcaccaagatcccggctgaaacactgcacgggacagtcacagtggaggtacagtacgcagggacagatggaccttgcaaggttccagctcagatggcggtggacatgcaaactctgaccccagttgggaggttgataaccgctaaccccgtaatcactgaaagcactgagaactctaagatgatgctggaacttgatccaccatttggggactcttacattgtcataggagtcggggagaagaagatcacccaccactggcacaggagtggcagcaccattggaaaagcatttgaagccactgtgagaggtgccaagagaatggcagtcttgggagacacagcctgggactttggatcagttggaggcgctctcaactcattgggcaagggcatccatcaaatttttggagcagctttcaaatcattgtttggaggaatgtcctggttctcacaaattctcattggaacgttgctgatgtggttgggtctgaacacaaagaatggatctatttcccttatgtgcttggccttagggggagtgttgatcttcttatccacagccgtctctgct

SEQ ID NO: 55 - DNA, 1773 bp, Artificial sequence
  Insert sE codon optimization (human)
cgcagaggagcggatacgtcagttggcattgtgggcttgctcctcaccaccgctatggccgcagaagttacaagaagagggtctgcctactacatgtatctggacaggaacgatgctggcgaagccatctcctttcccacaaccctggggatgaacaagtgctacattcagatcatggatcttggtcacatgtgcgatgccacaatgtcctatgagtgtcccatgctcgatgagggcgtcgagcctgacgacgttgattgctggtgtaacaccaccagcacctgggtggtctatggcacttgccatcacaagaagggtgaagcacggaggtcacgacgggcagtgacattgccaagtcatagcactaggaaactgcagactcgctcccagacctggcttgaatcccgagagtacacgaaacacctcattcgtgtggagaactggatcttccggaatcccgggtttgccctggctgctgccgctattgcctggttgctcggctctagcacatcacagaaagtcatctacctggtgatgatcttgctcattgctccagcctactctatcagatgcatcggagtttccaatcgtgactttgtcgaagggatgtccggaggcacctgggttgacgtggtgcttgagcatggtggctgcgtaacggtaatggctcaggacaaacccacggttgacatagaactggtgaccacgactgtcagtaatatggccgaagtgcgaagctactgctatgaggcctctatctctgacatggcatcagacagccggtgtccaactcaaggcgaagcttatctggacaagcaatccgatacacagtacgtgtgcaagcggactctcgtggatagaggttggggcaatgggtgtggtctgtttgggaaaggcagtctggtaacatgcgcaaagttcgcatgttccaagaaaatgacaggaaagagcattcagccggaaaatctggagtataggattatgctcagcgtgcatgggagccagcacagtggcatgattgtcaatgatacaggccacgaaaccgacgagaacagagcgaaggttgagatcactcccaattcacctcgcgcagaggccactctgggagggtttggaagtctcggtctggactgtgaacctcgcactggcctggacttcagcgatctgtattacctgacgatgaacaacaagcattggctggtccataaggagtggttccatgatattccgcttccttggcatgccggagccgataccggaacaccccactggaacaacaaagaggctttggtggagttcaaagatgcacacgctaagcgccaaaccgtcgtggtcctgggtagccaagaaggagcggttcacactgcgcttgccggagccctggaggcggaaatggatggggccaaagggcgcctttccagtggacacctgaagtgtcggctgaaaatggacaagctgagactgaaaggtgtgtcttacagcctgtgcaccgcagccttcactttcaccaaaatccctgctgaaaccttgcacggaacagtgacagtagaggtgcagtatgcaggcacagatggcccatgtaaggtgccagctcagatggcagtggacatgcagaccctgactccagtgggaaggctcataactgccaatccggtcatcacagagtctaccgagaactcaaagatgatgctggagctggaccctccctttggggactcttacatagtcataggggtaggcgagaagaaaatcacccatcactggcacaggagc

SEQ ID NO: 56 - DNA, 2076 bp, Artificial sequence
  Insert RSP codon optimization (human) L107D
cgcagaggcgctgatacctcagttggtatagtgggattgctgttgacaaccgccatggccgcagaagtgacgagaaggggttctgcctactatatgtaccttgatcggaatgacgctggagaggcaatctcattcccgaccaccttgggcatgaacaaatgctacatccagattatggacctgggacatatgtgcgatgccactatgagctatgagtgccccatgctggatgagggagtagagcctgacgatgttgactgctggtgtaacaccactagtacatgggtggtgtacggaacgtgccaccacaagaaaggagaagctcgaagatcccgtcgcgcggttactcttccctcccattccacaaggaaactccaaacccgtagccagacatggcttgaaagccgagaatacactaaacacttgatacgggtagagaactggattttccgcaatcccgggtttgctcttgcagctgcggcaattgcttggctcctcgggtcaagcacatcccagaaggtgatctacctggtgatgatcctgctgattgcaccagcctattcaatccggtgtatcggtgtctcaaatcgtgacttcgtcgaggggatgagtggcgggacctgggtggatgtcgttctggaacatggaggctgtgtaacggtgatggctcaagacaagccaaccgttgacatcgaactggtaacgacgacagtcagcaatatggccgaagtccgctcttactgctatgaagccagcatcagcgatatggccagcgatagtcgatgtccgactcaaggcgaagcctatctcgacaaacagtctgacacccagtacgtgtgcaagaggactctcgtggatagagggtggggcaatggttgtggggatttcggcaaggggtcactggtaacctgtgcaaagttcgcctgctctaagaagatgactgggaagagtatccagcccgagaatctggagtataggatcatgctgagcgttcatggatcccagcatagcgggatgatcgtgaatgatacgggtcacgaaacagacgagaaccgcgcaaaggtcgagattactcccaattcccctagggccgaagccacactcggaggctttggcagtctcggcctggattgcgagcctcgcactggactggatttctccgacctgtactacctgactatgaacaacaaacattggctggtgcacaaggaatggtttcacgacattcccctgccttggcacgctggggctgacactggtacacctcattggaacaacaaagaggctctggtggagttcaaagatgcacatgccaagagacaaaccgtggtggttctgggatcacaggaaggcgccgtgcataccgcgcttgccggagcactggaagcagagatggacggtgctaaaggccggttgagctctggccaccttaagtgtcggctgaagatggacaagctgagattgaaaggagtctcctatagtctgtgtacagccgcgtttacctttacgaaaatccccgctgagacactgcacggaacagtgaccgtggaggtgcaatatgcagggactgatggcccatgtaaggtgccagcacagatggctgttgacatgcagactctcaccccagtcggcaggcttattactgccaatccggtcataaccgagagtacagagaatagcaagatgatgctggagcttgaccctccattcggagactcctacattgtcattggcgtcggtgagaagaagattacccaccactggcacaggtctggctccacaatcggtaaagccttcgaagcgacagtgagaggagccaaacggatggcggtactcggagacacagcctgggatttcgggagcgttggtggcgctctgaactctctcgggaaaggtatccaccagatatttggggcagcctttaaatcactctttggcggcatgagctggttttctcagatcctgattgggaccctcctgatgtggctggggctgaacaccaagaacggctctataagcctgatgtgcttggccctgggcggggtgttgattttcctgtccaccgctgtgagtgcc

SEQ ID NO: 57 - DNA, 20896 bp, Artificial sequence
  MV Zika sE codon optimization (human)
tcatgaacgcggccgctaatacgactcactatagggccaactttgtttggtctgatgagtccgtgaggacgaaacccggagtcccgggtcaccaaacaaagttgggtaaggatagttcaatcaatgatcatcttctagtgcacttaggattcaagatcctattatcagggacaagagcaggattagggatatccgagatggccacacttttaaggagcttagcattgttcaaaagaaacaaggacaaaccacccattacatcaggatccggtggagccatcagaggaatcaaacacattattatagtaccaatccctggagattcctcaattaccactcgatccagacttctggaccggttggtgaggttaattggaaacccggatgtgagcgggcccaaactaacaggggcactaataggtatattatccttatttgtggagtctccaggtcaattgattcagaggatcaccgatgaccctgacgttagcataaggctgttagaggttgtccagagtgaccagtcacaatctggccttaccttcgcatcaagaggtaccaacatggaggatgaggcggaccaatacttttcacatgatgatccaattagtagtgatcaatccaggttcggatggttcgggaacaaggaaatctcagatattgaagtgcaagaccctgagggattcaacatgattctgggtaccatcctagcccaaatttgggtcttgctcgcaaaggcggttacggccccagacacggcagctgattcggagctaagaaggtggataaagtacacccaacaaagaagggtagttggtgaatttagattggagagaaaatggttggatgtggtgaggaacaggattgccgaggacctctccttacgccgattcatggtcgctctaatcctggatatcaagagaacacccggaaacaaacccaggattgctgaaatgatatgtgacattgatacatatatcgtagaggcaggattagccagttttatcctgactattaagtttgggatagaaactatgtatcctgctcttggactgcatgaatttgctggtgagttatccacacttgagtccttgatgaacctttaccagcaaatgggggaaactgcaccctacatggtaatcctggagaactcaattcagaacaagttcagtgcaggatcataccctctgctctggagctatgccatgggagtaggagtggaacttgaaaactccatgggaggtttgaactttggccgatcttactttgatccagcatattttagattagggcaagagatggtaaggaggtcagctggaaaggtcagttccacattggcatctgaactcggtatcactgccgaggatgcaaggcttgtttcagagattgcaatgcatactactgaggacaagatcagtagagcggttggacccagacaagcccaagtatcatttctacacggtgatcaaagtgagaatgagctaccgagattggggggcaaggaagataggagggtcaaacagagtcgaggagaagccagggagagctacagagaaaccgggcccagcagagcaagtgatgcgagagctgcccatcttccaaccggcacacccctagacattgacactgcaacggagtccagccaagatccgcaggacagtcgaaggtcagctgacgccctgcttaggctgcaagccatggcaggaatctcggaagaacaaggctcagacacggacacccctatagtgtacaatgacagaaatcttctagactaggtgcgagaggccgagggccagaacaacatccgcctaccatccatcattgttataaaaaacttaggaaccaggtccacacagccgccagcccatcaaccatccactcccacgattggagccaatggcagaagagcaggcacgccatgtcaaaaacggactggaatgcatccgggctctcaaggccgagcccatcggctcactggccatcgaggaagctatggcagcatggtcagaaatatcagacaacccaggacaggagcgagccacctgcagggaagagaaggcaggcagttcgggtctcagcaaaccatgcctctcagcaattggatcaactgaaggcggtgcacctcgcatccgcggtcagggacctggagagagcgatgacgacgctgaaactttgggaatccccccaagaaatctccaggcatcaagcactgggttacagtgttattacgtttatgatcacagcggtgaagcggttaagggaatccaagatgctgactctatcatggttcaatcaggccttgatggtgatagcaccctctcaggaggagacaatgaatctgaaaacagcgatgtggatattggcgaacctgataccgagggatatgctatcactgaccggggatctgctcccatctctatggggttcagggcttctgatgttgaaactgcagaaggaggggagatccacgagctcctgagactccaatccagaggcaacaactttccgaagcttgggaaaactctcaatgttcctccgcccccggaccccggtagggccagcacttccgggacacccattaaaaagggcacagacgcgagattagcctcatttggaacggagatcgcgtctttattgacaggtggtgcaacccaatgtgctcgaaagtcaccctcggaaccatcagggccaggtgcacctgcggggaatgtccccgagtgtgtgagcaatgccgcactgatacaggagtggacacccgaatctggtaccacaatctccccgagatcccagaataatgaagaagggggagactattatgatgatgagctgttctctgatgtccaagatattaaaacagccttggccaaaatacacgaggataatcagaagataatctccaagctagaatcactgctgttattgaagggagaagttgagtcaattaagaagcagatcaacaggcaaaatatcagcatatccaccctggaaggacacctctcaagcatcatgatcgccattcctggacttgggaaggatcccaacgaccccactgcagatgtcgaaatcaatcccgacttgaaacccatcataggcagagattcaggccgagcactggccgaagttctcaagaaacccgttgccagccgacaactccaaggaatgacaaatggacggaccagttccagaggacagctgctgaaggaatttcagctaaagccgatcgggaaaaagatgagctcagccgtcgggtttgttcctgacaccggccctgcatcacgcagtgtaatccgctccattataaaatccagccggctagaggaggatcggaagcgttacctgatgactctccttgatgatatcaaaggagccaatgatcttgccaagttccaccagatgctgatgaagataataatgaagtagctacagctcaacttacctgccaaccccatgccagtcgacccaactagcctaccctccatcattgttataaaaaacttaggaaccaggtccacacagccgccagcccatcaacgcgtacggccaccatggcacgcagaggagcggatacgtcagttggcattgtgggcttgctcctcaccaccgctatggccgcagaagttacaagaagagggtctgcctactacatgtatctggacaggaacgatgctggcgaagccatctcctttcccacaaccctggggatgaacaagtgctacattcagatcatggatcttggtcacatgtgcgatgccacaatgtcctatgagtgtcccatgctcgatgagggcgtcgagcctgacgacgttgattgctggtgtaacaccaccagcacctgggtggtctatggcacttgccatcacaagaagggtgaagcacggaggtcacgacgggcagtgacattgccaagtcatagcactaggaaactgcagactcgctcccagacctggcttgaatcccgagagtacacgaaacacctcattcgtgtggagaactggatcttccggaatcccgggtttgccctggctgctgccgctattgcctggttgctcggctctagcacatcacagaaagtcatctacctggtgatgatcttgctcattgctccagcctactctatcagatgcatcggagtttccaatcgtgactttgtcgaagggatgtccggaggcacctgggttgacgtggtgcttgagcatggtggctgcgtaacggtaatggctcaggacaaacccacggttgacatagaactggtgaccacgactgtcagtaatatggccgaagtgcgaagctactgctatgaggcctctatctctgacatggcatcagacagccggtgtccaactcaaggcgaagcttatctggacaagcaatccgatacacagtacgtgtgcaagcggactctcgtggatagaggttggggcaatgggtgtggtctgtttgggaaaggcagtctggtaacatgcgcaaagttcgcatgttccaagaaaatgacaggaaagagcattcagccggaaaatctggagtataggattatgctcagcgtgcatgggagccagcacagtggcatgattgtcaatgatacaggccacgaaaccgacgagaacagagcgaaggttgagatcactcccaattcacctcgcgcagaggccactctgggagggtttggaagtctcggtctggactgtgaacctcgcactggcctggacttcagcgatctgtattacctgacgatgaacaacaagcattggctggtccataaggagtggttccatgatattccgcttccttggcatgccggagccgataccggaacaccccactggaacaacaaagaggctttggtggagttcaaagatgcacacgctaagcgccaaaccgtcgtggtcctgggtagccaagaaggagcggttcacactgcgcttgccggagccctggaggcggaaatggatggggccaaagggcgcctttccagtggacacctgaagtgtcggctgaaaatggacaagctgagactgaaaggtgtgtcttacagcctgtgcaccgcagccttcactttcaccaaaatccctgctgaaaccttgcacggaacagtgacagtagaggtgcagtatgcaggcacagatggcccatgtaaggtgccagctcagatggcagtggacatgcagaccctgactccagtgggaaggctcataactgccaatccggtcatcacagagtctaccgagaactcaaagatgatgctggagctggaccctccctttggggactcttacatagtcataggggtaggcgagaagaaaatcacccatcactggcacaggagctaatgataagcgcgcagcgcttagacgtctcgcgatcgatactagtacaacctaaatccattataaaaaacttaggagcaaagtgattgcctcccaaggtccacaatgacagagacctacgacttcgacaagtcggcatgggacatcaaagggtcgatcgctccgatacaacccaccacctacagtgatggcaggctggtgccccaggtcagagtcatagatcctggtctaggcgacaggaaggatgaatgctttatgtacatgtttctgctgggggttgttgaggacagcgattccctagggcctccaatcgggcgagcatttgggttcctgcccttaggtgttggcagatccacagcaaagcccgaaaaactcctcaaagaggccactgagcttgacatagttgttagacgtacagcagggctcaatgaaaaactggtgttctacaacaacaccccactaactctcctcacaccttggagaaaggtcctaacaacagggagtgtcttcaacgcaaaccaagtgtgcaatgcggttaatctgataccgctcgataccccgcagaggttccgtgttgtttatatgagcatcacccgtctttcggataacgggtattacaccgttcctagaagaatgctggaattcagatcggtcaatgcagtggccttcaacctgctggtgacccttaggattgacaaggcgataggccctgggaagatcatcgacaatacagagcaacttcctgaggcaacatttatggtccacatcgggaacttcaggagaaagaagagtgaagtctactctgccgattattgcaaaatgaaaatcgaaaagatgggcctggtttttgcacttggtgggatagggggcaccagtcttcacattagaagcacaggcaaaatgagcaagactctccatgcacaactcgggttcaagaagaccttatgttacccgctgatggatatcaatgaagaccttaatcgattactctggaggagcagatgcaagatagtaagaatccaggcagttttgcagccatcagttcctcaagaattccgcatttacgacgacgtgatcataaatgatgaccaaggactattcaaagttctgtagaccgtagtgcccagcaatgcccgaaaacgacccccctcacaatgacagccagaaggcccggacaaaaaagccccctccgaaagactccacggaccaagcgagaggccagccagcagccgacggcaagcgcgaacaccaggcggccccagcacagaacagccctgacacaaggccaccaccagccaccccaatctgcatcctcctcgtgggacccccgaggaccaacccccaaggctgcccccgatccaaaccaccaaccgcatccccaccacccccgggaaagaaacccccagcaattggaaggcccctccccctcttcctcaacacaagaactccacaaccgaaccgcacaagcgaccgaggtgacccaaccgcaggcatccgactccctagacagatcctctctccccggcaaactaaacaaaacttagggccaaggaacatacacacccaacagaacccagaccccggcccacggcgccgcgcccccaacccccgacaaccagagggagcccccaaccaatcccgccggctcccccggtgcccacaggcagggacaccaacccccgaacagacccagcacccaaccatcgacaatccaagacgggggggcccccccaaaaaaaggcccccaggggccgacagccagcaccgcgaggaagcccacccaccccacacacgaccacggcaaccaaaccagaacccagaccaccctgggccaccagctcccagactcggccatcaccccgcagaaaggaaaggccacaacccgcgcaccccagccccgatccggcggggagccacccaacccgaaccagcacccaagagcgatccccgaaggacccccgaaccgcaaaggacatcagtatcccacagcctctccaagtcccccggtctcctcctcttctcgaagggaccaaaagatcaatccaccacacccgacgacactcaactccccacccctaaaggagacaccgggaatcccagaatcaagactcatccaatgtccatcatgggtctcaaggtgaacgtctctgccatattcatggcagtactgttaactctccaaacacccaccggtcaaatccattggggcaatctctctaagataggggtggtaggaataggaagtgcaagctacaaagttatgactcgttccagccatcaatcattagtcataaaattaatgcccaatataactctcctcaataactgcacgagggtagagattgcagaatacaggagactactgagaacagttttggaaccaattagagatgcacttaatgcaatgacccagaatataagaccggttcagagtgtagcttcaagtaggagacacaagagatttgcgggagtagtcctggcaggtgcggccctaggcgttgccacagctgctcagataacagccggcattgcacttcaccagtccatgctgaactctcaagccatcgacaatctgagagcgagcctggaaactactaatcaggcaattgagacaatcagacaagcagggcaggagatgatattggctgttcagggtgtccaagactacatcaataatgagctgataccgtctatgaaccaactatcttgtgatttaatcggccagaagctcgggctcaaattgctcagatactatacagaaatcctgtcattatttggccccagtttacgggaccccatatctgcggagatatctatccaggctttgagctatgcgcttggaggagacatcaataaggtgttagaaaagctcggatacagtggaggtgatttactgggcatcttagagagcggaggaataaaggcccggataactcacgtcgacacagagtcctacttcattgtcctcagtatagcctatccgacgctgtccgagattaagggggtgattgtccaccggctagagggggtctcgtacaacataggctctcaagagtggtataccactgtgcccaagtatgttgcaacccaagggtaccttatctcgaattttgatgagtcatcgtgtactttcatgccagaggggactgtgtgcagccaaaatgccttgtacccgatgagtcctctgctccaagaatgcctccgggggtacaccaagtcctgtgctcgtacactcgtatccgggtcttttgggaaccggttcattttatcacaagggaacctaatagccaattgtgcatcaatcctttgcaagtgttacacaacaggaacgatcattaatcaagaccctgacaagatcctaacatacattgctgccgatcactgcccggtagtcgaggtgaacggcgtgaccatccaagtcgggagcaggaggtatccagacgctgtgtacttgcacagaattgacctcggtcctcccatatcattggagaggttggacgtagggacaaatctggggaatgcaattgctaagttggaggatgccaaggaattgttggagtcatcggaccagatattgaggagtatgaaaggtttatcgagcactagcatagtctacatcctgattgcagtgtgtcttggagggttgatagggatccccgctttaatatgttgctgcagggggcgttgtaacaaaaagggagaacaagttggtatgtcaagaccaggcctaaagcctgatcttacgggaacatcaaaatcctatgtaaggtcgctctgatcctctacaactcttgaaacacaaatgtcccacaagtctcctcttcgtcatcaagcaaccaccgcacccagcatcaagcccacctgaaattatctccggcttccctctggccgaacaatatcggtagttaatcaaaacttagggtgcaagatcatccacaatgtcaccacaacgagaccggataaatgccttctacaaagataacccccatcccaagggaagtaggatagtcattaacagagaacatcttatgattgatagaccttatgttttgctggctgttctgtttgtcatgtttctgagcttgatcgggttgctagccattgcaggcattagacttcatcgggcagccatctacaccgcagagatccataaaagcctcagcaccaatctagatgtaactaactcaatcgagcatcaggtcaaggacgtgctgacaccactcttcaaaatcatcggtgatgaagtgggcctgaggacacctcagagattcactgacctagtgaaattaatctctgacaagattaaattccttaatccggatagggagtacgacttcagagatctcacttggtgtatcaacccgccagagagaatcaaattggattatgatcaatactgtgcagatgtggctgctgaagagctcatgaatgcattggtgaactcaactctactggagaccagaacaaccaatcagttcctagctgtctcaaagggaaactgctcagggcccactacaatcagaggtcaattctcaaacatgtcgctgtccctgttagacttgtatttaggtcgaggttacaatgtgtcatctatagtcactatgacatcccagggaatgtatgggggaacttacctagtggaaaagcctaatctgagcagcaaaaggtcagagttgtcacaactgagcatgtaccgagtgtttgaagtaggtgttatcagaaatccgggtttgggggctccggtgttccatatgacaaactatcttgagcaaccagtcagtaatgatctcagcaactgtatggtggctttgggggagctcaaactcgcagccctttgtcacggggaagattctatcacaattccctatcagggatcagggaaaggtgtcagcttccagctcgtcaagctaggtgtctggaaatccccaaccgacatgcaatcctgggtccccttatcaacggatgatccagtgatagacaggctttacctctcatctcacagaggtgttatcgctgacaatcaagcaaaatgggctgtcccgacaacacgaacagatgacaagttgcgaatggagacatgcttccaacaggcgtgtaagggtaaaatccaagcactctgcgagaatcccgagtgggcaccattgaaggataacaggattccttcatacggggtcttgtctgttgatctgagtctgacagttgagcttaaaatcaaaattgcttcgggattcgggccattgatcacacacggttcagggatggacctatacaaatccaaccacaacaatgtgtattggctgactatcccgccaatgaagaacctagccttaggtgtaatcaacacattggagtggataccgagattcaaggttagtccctacctcttcactgtcccaattaaggaagcaggcgaagactgccatgccccaacatacctacctgcggaggtggatggtgatgtcaaactcagttccaatctggtgattctacctggtcaagatctccaatatgttttggcaacctacgatacttccagggttgaacatgctgtggtttattacgtttacagcccaagccgctcattttcttacttttatccttttaggttgcctataaagggggtccccatcgaattacaagtggaatgcttcacatgggaccaaaaactctggtgccgtcacttctgtgtgcttgcggactcagaatctggtggacatatcactcactctgggatggtgggcatgggagtcagctgcacagtcacccgggaagatggaaccaatcgcagatagggctgctagtgaaccaatcacatgatgtcacccagacatcaggcatacccactagtgtgaaatagacatcagaattaagaaaaacgtagggtccaagtggttccccgttatggactcgctatctgtcaaccagatcttataccctgaagttcacctagatagcccgatagttaccaataagatagtagccatcctggagtatgctcgagtccctcacgcttacagcctggaggaccctacactgtgtcagaacatcaagcaccgcctaaaaaacggattttccaaccaaatgattataaacaatgtggaagttgggaatgtcatcaagtccaagcttaggagttatccggcccactctcatattccatatccaaattgtaatcaggatttatttaacatagaagacaaagagtcaacgaggaagatccgtgaactcctcaaaaaggggaattcgctgtactccaaagtcagtgataaggttttccaatgcttaagggacactaactcacggcttggcctaggctccgaattgagggaggacatcaaggagaaagttattaacttgggagtttacatgcacagctcccagtggtttgagccctttctgttttggtttacagtcaagactgagatgaggtcagtgattaaatcacaaacccatacttgccataggaggagacacacacctgtattcttcactggtagttcagttgagttgctaatctctcgtgaccttgttgctataatcagtaaagagtctcaacatgtatattacctgacatttgaactggttttgatgtattgtgatgtcatagaggggaggttaatgacagagaccgctatgactattgatgctaggtatacagagcttctaggaagagtcagatacatgtggaaactgatagatggtttcttccctgcactcgggaatccaacttatcaaattgtagccatgctggagcctctttcacttgcttacctgcagctgagggatataacagtagaactcagaggtgctttccttaaccactgctttactgaaatacatgatgttcttgaccaaaacgggttttctgatgaaggtacttatcatgagttaactgaagctctagattacattttcataactgatgacatacatctgacaggggagattttctcatttttcagaagtttcggccaccccagacttgaagcagtaacggctgctgaaaatgttaggaaatacatgaatcagcctaaagtcattgtgtatgagactctgatgaaaggtcatgccatattttgtggaatcataatcaacggctatcgtgacaggcacggaggcagttggccaccgctgaccctccccctgcatgctgcagacacaatccggaatgctcaagcttcaggtgaagggttaacacatgagcagtgcgttgataactggaaatcttttgctggagtgaaatttggctgctttatgcctcttagcctggatagtgatctgacaatgtacctaaaggacaaggcacttgctgctctccaaagggaatgggattcagtttacccgaaagagttcctgcgttacgaccctcccaagggaaccgggtcacggaggcttgtagatgttttccttaatgattcgagctttgacccatatgatgtgataatgtatgttgtaagtggagcttacctccatgaccctgagttcaacctgtcttacagcctgaaagaaaaggagatcaaggaaacaggtagactttttgctaaaatgacttacaaaatgagggcatgccaagtgattgctgaaaatctaatctcaaacgggattggcaaatattttaaggacaatgggatggccaaggatgagcacgatttgactaaggcactccacactctagctgtctcaggagtccccaaagatctcaaagaaagtcacaggggggggccagtcttaaaaacctactcccgaagcccagtccacacaagtaccaggaacgtgagagcagcaaaagggtttatagggttccctcaagtaattcggcaggaccaagacactgatcatccggagaatatggaagcttacgagacagtcagtgcatttatcacgactgatctcaagaagtactgccttaattggagatatgagaccatcagcttgtttgcacagaggctaaatgagatttacggattgccctcatttttccagtggctgcataagaggcttgagacctctgtcctgtatgtaagtgaccctcattgcccccccgaccttgacgcccatatcccgttatataaagtccccaatgatcaaatcttcattaagtaccctatgggaggtatagaagggtattgtcagaagctgtggaccatcagcaccattccctatctatacctggctgcttatgagagcggagtaaggattgcttcgttagtgcaaggggacaatcagaccatagccgtaacaaaaagggtacccagcacatggccctacaaccttaagaaacgggaagctgctagagtaactagagattactttgtaattcttaggcaaaggctacatgatattggccatcacctcaaggcaaatgagacaattgtttcatcacatttttttgtctattcaaaaggaatatattatgatgggctacttgtgtcccaatcactcaagagcatcgcaagatgtgtattctggtcagagactatagttgatgaaacaagggcagcatgcagtaatattgctacaacaatggctaaaagcatcgagagaggttatgaccgttaccttgcatattccctgaacgtcctaaaagtgatacagcaaattctgatctctcttggcttcacaatcaattcaaccatgacccgggatgtagtcatacccctcctcacaaacaacgacctcttaataaggatggcactgttgcccgctcctattggggggatgaattatctgaatatgagcaggctgtttgtcagaaacatcggtgatccagtaacatcatcaattgctgatctcaagagaatgattctcgcctcactaatgcctgaagagaccctccatcaagtaatgacacaacaaccgggggactcttcattcctagactgggctagcgacccttactcagcaaatcttgtatgtgtccagagcatcactagactcctcaagaacataactgcaaggtttgtcctgatccatagtccaaacccaatgttaaaaggattattccatgatgacagtaaagaagaggacgagggactggcggcattcctcatggacaggcatattatagtacctagggcagctcatgaaatcctggatcatagtgtcacaggggcaagagagtctattgcaggcatgctggataccacaaaaggcttgattcgagccagcatgaggaagggggggttaacctctcgagtgataaccagattgtccaattatgactatgaacaattcagagcagggatggtgctattgacaggaagaaagagaaatgtcctcattgacaaagagtcatgttcagtgcagctggcgagagctctaagaagccatatgtgggcgaggctagctcgaggacggcctatttacggccttgaggtccctgatgtactagaatctatgcgaggccaccttattcggcgtcatgagacatgtgtcatctgcgagtgtggatcagtcaactacggatggttttttgtcccctcgggttgccaactggatgatattgacaaggaaacatcatccttgagagtcccatatattggttctaccactgatgagagaacagacatgaagcttgccttcgtaagagccccaagtcgatccttgcgatctgctgttagaatagcaacagtgtactcatgggcttacggtgatgatgatagctcttggaacgaagcctggttgttggctaggcaaagggccaatgtgagcctggaggagctaagggtgatcactcccatctcaacttcgactaatttagcgcataggttgagggatcgtagcactcaagtgaaatactcaggtacatcccttgtccgagtggcgaggtataccacaatctccaacgacaatctctcatttgtcatatcagataagaaggttgatactaactttatataccaacaaggaatgcttctagggttgggtgttttagaaacattgtttcgactcgagaaagataccggatcatctaacacggtattacatcttcacgtcgaaacagattgttgcgtgatcccgatgatagatcatcccaggatacccagctcccgcaagctagagctgagggcagagctatgtaccaacccattgatatatgataatgcacctttaattgacagagatgcaacaaggctatacacccagagccataggaggcaccttgtggaatttgttacatggtccacaccccaactatatcacattttagctaagtccacagcactatctatgattgacctggtaacaaaatttgagaaggaccatatgaatgaaatttcagctctcataggggatgacgatatcaatagtttcataactgagtttctgctcatagagccaagattattcactatctacttgggccagtgtgcggccatcaattgggcatttgatgtacattatcatagaccatcagggaaatatcagatgggtgagctgttgtcatcgttcctttctagaatgagcaaaggagtgtttaaggtgcttgtcaatgctctaagccacccaaagatctacaagaaattctggcattgtggtattatagagcctatccatggtccttcacttgatgctcaaaacttgcacacaactgtgtgcaacatggtttacacatgctatatgacctacctcgacctgttgttgaatgaagagttagaagagttcacatttctcttgtgtgaaagcgacgaggatgtagtaccggacagattcgacaacatccaggcaaaacacttatgtgttctggcagatttgtactgtcaaccagggacctgcccaccaattcgaggtctaagaccggtagagaaatgtgcagttctaaccgaccatatcaaggcagaggctatgttatctccagcaggatcttcgtggaacataaatccaattattgtagaccattactcatgctctctgacttatctccggcgaggatcgatcaaacagataagattgagagttgatccaggattcattttcgacgccctcgctgaggtaaatgtcagtcagccaaagatcggcagcaacaacatctcaaatatgagcatcaaggctttcagacccccacacgatgatgttgcaaaattgctcaaagatatcaacacaagcaagcacaatcttcccatttcagggggcaatctcgccaattatgaaatccatgctttccgcagaatcgggttgaactcatctgcttgctacaaagctgttgagatatcaacattaattaggagatgccttgagccaggggaggacggcttgttcttgggtgagggatcgggttctatgttgatcacttataaagagatacttaaactaaacaagtgcttctataatagtggggtttccgccaattctagatctggtcaaagggaattagcaccctatccctccgaagttggccttgtcgaacacagaatgggagtaggtaatattgtcaaagtgctctttaacgggaggcccgaagtcacgtgggtaggcagtgtagattgcttcaatttcatagttagtaatatccctacctctagtgtggggtttatccattcagatatagagaccttgcctgacaaagatactatagagaagctagaggaattggcagccatcttatcgatggctctgctcctgggcaaaataggatcaatactggtgattaagcttatgcctttcagcggggattttgttcagggatttataagttatgtagggtctcattatagagaagtgaaccttgtataccctagatacagcaacttcatctctactgaatcttatttggttatgacagatctcaaggctaaccggctaatgaatcctgaaaagattaagcagcagataattgaatcatctgtgaggacttcacctggacttataggtcacatcctatccattaagcaactaagctgcatacaagcaattgtgggagacgcagttagtagaggtgatatcaatcctactctgaaaaaacttacacctatagagcaggtgctgatcaattgcgggttggcaattaacggacctaagctgtgcaaagaattgatccaccatgatgttgcctcagggcaagatggattgcttaattctatactcatcctctacagggagttggcaagattcaaagacaaccaaagaagtcaacaagggatgttccacgcttaccccgtattggtaagtagcaggcaacgagaacttatatctaggatcacccgcaaattctgggggcacattcttctttactccgggaacaaaaagttgataaataagtttatccagaatctcaagtccggctatctgatactagacttacaccagaatatcttcgttaagaatctatccaagtcagagaaacagattattatgacggggggtttgaaacgtgagtgggtttttaaggtaacagtcaaggagaccaaagaatggtataagttagtcggatacagtgccctgattaaggactaattggttgaactccggaaccctaatcctgccctaggtggttaggcattatttgcaatatattaaagaaaactttgaaaatacgaagtttctattcccagctttgtctggtggccggcatggtcccagcctcctcgctggcgccggctgggcaacattccgaggggaccgtcccctcggtaatggcgaatgggacgcggccgatccggctgctaacaaagcccgaaaggaagctgagttggctgctgccaccgctgagcaataactagcataaccccttggggcctctaaacgggtcttgaggggttttttgctgaaaggaggaactatatccggatgcggccgcgggccctatggtacccagcttttgttccctttagtgagggttaattccgagcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctcggcccccctgacgagcatcacaaaaatcgacgctcaagtcagaggtggcgaaacccgacaggactataaagataccaggcgttcccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactgcccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgaaaaaaagcggttagctccttcggtcctccgatcgttgtcagaagtaagttggccgcagtgttatcactcatgcttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagccaccgcggtgatccttataaagctagatg

SEQ ID NO: 58 - DNA, 21196 bp, Artificial sequence
  MV Zika RSP codon optimization (human) L107D
tcatgaacgcggccgctaatacgactcactatagggccaactttgtttggtctgatgagtccgtgaggacgaaacccggagtcccgggtcaccaaacaaagttgggtaaggatagttcaatcaatgatcatcttctagtgcacttaggattcaagatcctattatcagggacaagagcaggattagggatatccgagatggccacacttttaaggagcttagcattgttcaaaagaaacaaggacaaaccacccattacatcaggatccggtggagccatcagaggaatcaaacacattattatagtaccaatccctggagattcctcaattaccactcgatccagacttctggaccggttggtgaggttaattggaaacccggatgtgagcgggcccaaactaacaggggcactaataggtatattatccttatttgtggagtctccaggtcaattgattcagaggatcaccgatgaccctgacgttagcataaggctgttagaggttgtccagagtgaccagtcacaatctggccttaccttcgcatcaagaggtaccaacatggaggatgaggcggaccaatacttttcacatgatgatccaattagtagtgatcaatccaggttcggatggttcgggaacaaggaaatctcagatattgaagtgcaagaccctgagggattcaacatgattctgggtaccatcctagcccaaatttgggtcttgctcgcaaaggcggttacggccccagacacggcagctgattcggagctaagaaggtggataaagtacacccaacaaagaagggtagttggtgaatttagattggagagaaaatggttggatgtggtgaggaacaggattgccgaggacctctccttacgccgattcatggtcgctctaatcctggatatcaagagaacacccggaaacaaacccaggattgctgaaatgatatgtgacattgatacatatatcgtagaggcaggattagccagttttatcctgactattaagtttgggatagaaactatgtatcctgctcttggactgcatgaatttgctggtgagttatccacacttgagtccttgatgaacctttaccagcaaatgggggaaactgcaccctacatggtaatcctggagaactcaattcagaacaagttcagtgcaggatcataccctctgctctggagctatgccatgggagtaggagtggaacttgaaaactccatgggaggtttgaactttggccgatcttactttgatccagcatattttagattagggcaagagatggtaaggaggtcagctggaaaggtcagttccacattggcatctgaactcggtatcactgccgaggatgcaaggcttgtttcagagattgcaatgcatactactgaggacaagatcagtagagcggttggacccagacaagcccaagtatcatttctacacggtgatcaaagtgagaatgagctaccgagattggggggcaaggaagataggagggtcaaacagagtcgaggagaagccagggagagctacagagaaaccgggcccagcagagcaagtgatgcgagagctgcccatcttccaaccggcacacccctagacattgacactgcaacggagtccagccaagatccgcaggacagtcgaaggtcagctgacgccctgcttaggctgcaagccatggcaggaatctcggaagaacaaggctcagacacggacacccctatagtgtacaatgacagaaatcttctagactaggtgcgagaggccgagggccagaacaacatccgcctaccatccatcattgttataaaaaacttaggaaccaggtccacacagccgccagcccatcaaccatccactcccacgattggagccaatggcagaagagcaggcacgccatgtcaaaaacggactggaatgcatccgggctctcaaggccgagcccatcggctcactggccatcgaggaagctatggcagcatggtcagaaatatcagacaacccaggacaggagcgagccacctgcagggaagagaaggcaggcagttcgggtctcagcaaaccatgcctctcagcaattggatcaactgaaggcggtgcacctcgcatccgcggtcagggacctggagagagcgatgacgacgctgaaactttgggaatccccccaagaaatctccaggcatcaagcactgggttacagtgttattacgtttatgatcacagcggtgaagcggttaagggaatccaagatgctgactctatcatggttcaatcaggccttgatggtgatagcaccctctcaggaggagacaatgaatctgaaaacagcgatgtggatattggcgaacctgataccgagggatatgctatcactgaccggggatctgctcccatctctatggggttcagggcttctgatgttgaaactgcagaaggaggggagatccacgagctcctgagactccaatccagaggcaacaactttccgaagcttgggaaaactctcaatgttcctccgcccccggaccccggtagggccagcacttccgggacacccattaaaaagggcacagacgcgagattagcctcatttggaacggagatcgcgtctttattgacaggtggtgcaacccaatgtgctcgaaagtcaccctcggaaccatcagggccaggtgcacctgcggggaatgtccccgagtgtgtgagcaatgccgcactgatacaggagtggacacccgaatctggtaccacaatctccccgagatcccagaataatgaagaagggggagactattatgatgatgagctgttctctgatgtccaagatattaaaacagccttggccaaaatacacgaggataatcagaagataatctccaagctagaatcactgctgttattgaagggagaagttgagtcaattaagaagcagatcaacaggcaaaatatcagcatatccaccctggaaggacacctctcaagcatcatgatcgccattcctggacttgggaaggatcccaacgaccccactgcagatgtcgaaatcaatcccgacttgaaacccatcataggcagagattcaggccgagcactggccgaagttctcaagaaacccgttgccagccgacaactccaaggaatgacaaatggacggaccagttccagaggacagctgctgaaggaatttcagctaaagccgatcgggaaaaagatgagctcagccgtcgggtttgttcctgacaccggccctgcatcacgcagtgtaatccgctccattataaaatccagccggctagaggaggatcggaagcgttacctgatgactctccttgatgatatcaaaggagccaatgatcttgccaagttccaccagatgctgatgaagataataatgaagtagctacagctcaacttacctgccaaccccatgccagtcgacccaactagcctaccctccatcattgttataaaaaacttaggaaccaggtccacacagccgccagcccatcaacgcgtacggccaccatggcacgcagaggcgctgatacctcagttggtatagtgggattgctgttgacaaccgccatggccgcagaagtgacgagaaggggttctgcctactatatgtaccttgatcggaatgacgctggagaggcaatctcattcccgaccaccttgggcatgaacaaatgctacatccagattatggacctgggacatatgtgcgatgccactatgagctatgagtgccccatgctggatgagggagtagagcctgacgatgttgactgctggtgtaacaccactagtacatgggtggtgtacggaacgtgccaccacaagaaaggagaagctcgaagatcccgtcgcgcggttactcttccctcccattccacaaggaaactccaaacccgtagccagacatggcttgaaagccgagaatacactaaacacttgatacgggtagagaactggattttccgcaatcccgggtttgctcttgcagctgcggcaattgcttggctcctcgggtcaagcacatcccagaaggtgatctacctggtgatgatcctgctgattgcaccagcctattcaatccggtgtatcggtgtctcaaatcgtgacttcgtcgaggggatgagtggcgggacctgggtggatgtcgttctggaacatggaggctgtgtaacggtgatggctcaagacaagccaaccgttgacatcgaactggtaacgacgacagtcagcaatatggccgaagtccgctcttactgctatgaagccagcatcagcgatatggccagcgatagtcgatgtccgactcaaggcgaagcctatctcgacaaacagtctgacacccagtacgtgtgcaagaggactctcgtggatagagggtggggcaatggttgtggggatttcggcaaggggtcactggtaacctgtgcaaagttcgcctgctctaagaagatgactgggaagagtatccagcccgagaatctggagtataggatcatgctgagcgttcatggatcccagcatagcgggatgatcgtgaatgatacgggtcacgaaacagacgagaaccgcgcaaaggtcgagattactcccaattcccctagggccgaagccacactcggaggctttggcagtctcggcctggattgcgagcctcgcactggactggatttctccgacctgtactacctgactatgaacaacaaacattggctggtgcacaaggaatggtttcacgacattcccctgccttggcacgctggggctgacactggtacacctcattggaacaacaaagaggctctggtggagttcaaagatgcacatgccaagagacaaaccgtggtggttctgggatcacaggaaggcgccgtgcataccgcgcttgccggagcactggaagcagagatggacggtgctaaaggccggttgagctctggccaccttaagtgtcggctgaagatggacaagctgagattgaaaggagtctcctatagtctgtgtacagccgcgtttacctttacgaaaatccccgctgagacactgcacggaacagtgaccgtggaggtgcaatatgcagggactgatggcccatgtaaggtgccagcacagatggctgttgacatgcagactctcaccccagtcggcaggcttattactgccaatccggtcataaccgagagtacagagaatagcaagatgatgctggagcttgaccctccattcggagactcctacattgtcattggcgtcggtgagaagaagattacccaccactggcacaggtctggctccacaatcggtaaagccttcgaagcgacagtgagaggagccaaacggatggcggtactcggagacacagcctgggatttcgggagcgttggtggcgctctgaactctctcgggaaaggtatccaccagatatttggggcagcctttaaatcactctttggcggcatgagctggttttctcagatcctgattgggaccctcctgatgtggctggggctgaacaccaagaacggctctataagcctgatgtgcttggccctgggcggggtgttgattttcctgtccaccgctgtgagtgcctaatgagcgcgcagcgcttagacgtctcgcgatcgatactagtacaacctaaatccattataaaaaacttaggagcaaagtgattgcctcccaaggtccacaatgacagagacctacgacttcgacaagtcggcatgggacatcaaagggtcgatcgctccgatacaacccaccacctacagtgatggcaggctggtgccccaggtcagagtcatagatcctggtctaggcgacaggaaggatgaatgctttatgtacatgtttctgctgggggttgttgaggacagcgattccctagggcctccaatcgggcgagcatttgggttcctgcccttaggtgttggcagatccacagcaaagcccgaaaaactcctcaaagaggccactgagcttgacatagttgttagacgtacagcagggctcaatgaaaaactggtgttctacaacaacaccccactaactctcctcacaccttggagaaaggtcctaacaacagggagtgtcttcaacgcaaaccaagtgtgcaatgcggttaatctgataccgctcgataccccgcagaggttccgtgttgtttatatgagcatcacccgtctttcggataacgggtattacaccgttcctagaagaatgctggaattcagatcggtcaatgcagtggccttcaacctgctggtgacccttaggattgacaaggcgataggccctgggaagatcatcgacaatacagagcaacttcctgaggcaacatttatggtccacatcgggaacttcaggagaaagaagagtgaagtctactctgccgattattgcaaaatgaaaatcgaaaagatgggcctggtttttgcacttggtgggatagggggcaccagtcttcacattagaagcacaggcaaaatgagcaagactctccatgcacaactcgggttcaagaagaccttatgttacccgctgatggatatcaatgaagaccttaatcgattactctggaggagcagatgcaagatagtaagaatccaggcagttttgcagccatcagttcctcaagaattccgcatttacgacgacgtgatcataaatgatgaccaaggactattcaaagttctgtagaccgtagtgcccagcaatgcccgaaaacgacccccctcacaatgacagccagaaggcccggacaaaaaagccccctccgaaagactccacggaccaagcgagaggccagccagcagccgacggcaagcgcgaacaccaggcggccccagcacagaacagccctgacacaaggccaccaccagccaccccaatctgcatcctcctcgtgggacccccgaggaccaacccccaaggctgcccccgatccaaaccaccaaccgcatccccaccacccccgggaaagaaacccccagcaattggaaggcccctccccctcttcctcaacacaagaactccacaaccgaaccgcacaagcgaccgaggtgacccaaccgcaggcatccgactccctagacagatcctctctccccggcaaactaaacaaaacttagggccaaggaacatacacacccaacagaacccagaccccggcccacggcgccgcgcccccaacccccgacaaccagagggagcccccaaccaatcccgccggctcccccggtgcccacaggcagggacaccaacccccgaacagacccagcacccaaccatcgacaatccaagacgggggggcccccccaaaaaaaggcccccaggggccgacagccagcaccgcgaggaagcccacccaccccacacacgaccacggcaaccaaaccagaacccagaccaccctgggccaccagctcccagactcggccatcaccccgcagaaaggaaaggccacaacccgcgcaccccagccccgatccggcggggagccacccaacccgaaccagcacccaagagcgatccccgaaggacccccgaaccgcaaaggacatcagtatcccacagcctctccaagtcccccggtctcctcctcttctcgaagggaccaaaagatcaatccaccacacccgacgacactcaactccccacccctaaaggagacaccgggaatcccagaatcaagactcatccaatgtccatcatgggtctcaaggtgaacgtctctgccatattcatggcagtactgttaactctccaaacacccaccggtcaaatccattggggcaatctctctaagataggggtggtaggaataggaagtgcaagctacaaagttatgactcgttccagccatcaatcattagtcataaaattaatgcccaatataactctcctcaataactgcacgagggtagagattgcagaatacaggagactactgagaacagttttggaaccaattagagatgcacttaatgcaatgacccagaatataagaccggttcagagtgtagcttcaagtaggagacacaagagatttgcgggagtagtcctggcaggtgcggccctaggcgttgccacagctgctcagataacagccggcattgcacttcaccagtccatgctgaactctcaagccatcgacaatctgagagcgagcctggaaactactaatcaggcaattgagacaatcagacaagcagggcaggagatgatattggctgttcagggtgtccaagactacatcaataatgagctgataccgtctatgaaccaactatcttgtgatttaatcggccagaagctcgggctcaaattgctcagatactatacagaaatcctgtcattatttggccccagtttacgggaccccatatctgcggagatatctatccaggctttgagctatgcgcttggaggagacatcaataaggtgttagaaaagctcggatacagtggaggtgatttactgggcatcttagagagcggaggaataaaggcccggataactcacgtcgacacagagtcctacttcattgtcctcagtatagcctatccgacgctgtccgagattaagggggtgattgtccaccggctagagggggtctcgtacaacataggctctcaagagtggtataccactgtgcccaagtatgttgcaacccaagggtaccttatctcgaattttgatgagtcatcgtgtactttcatgccagaggggactgtgtgcagccaaaatgccttgtacccgatgagtcctctgctccaagaatgcctccgggggtacaccaagtcctgtgctcgtacactcgtatccgggtcttttgggaaccggttcattttatcacaagggaacctaatagccaattgtgcatcaatcctttgcaagtgttacacaacaggaacgatcattaatcaagaccctgacaagatcctaacatacattgctgccgatcactgcccggtagtcgaggtgaacggcgtgaccatccaagtcgggagcaggaggtatccagacgctgtgtacttgcacagaattgacctcggtcctcccatatcattggagaggttggacgtagggacaaatctggggaatgcaattgctaagttggaggatgccaaggaattgttggagtcatcggaccagatattgaggagtatgaaaggtttatcgagcactagcatagtctacatcctgattgcagtgtgtcttggagggttgatagggatccccgctttaatatgttgctgcagggggcgttgtaacaaaaagggagaacaagttggtatgtcaagaccaggcctaaagcctgatcttacgggaacatcaaaatcctatgtaaggtcgctctgatcctctacaactcttgaaacacaaatgtcccacaagtctcctcttcgtcatcaagcaaccaccgcacccagcatcaagcccacctgaaattatctccggcttccctctggccgaacaatatcggtagttaatcaaaacttagggtgcaagatcatccacaatgtcaccacaacgagaccggataaatgccttctacaaagataacccccatcccaagggaagtaggatagtcattaacagagaacatcttatgattgatagaccttatgttttgctggctgttctgtttgtcatgtttctgagcttgatcgggttgctagccattgcaggcattagacttcatcgggcagccatctacaccgcagagatccataaaagcctcagcaccaatctagatgtaactaactcaatcgagcatcaggtcaaggacgtgctgacaccactcttcaaaatcatcggtgatgaagtgggcctgaggacacctcagagattcactgacctagtgaaattaatctctgacaagattaaattccttaatccggatagggagtacgacttcagagatctcacttggtgtatcaacccgccagagagaatcaaattggattatgatcaatactgtgcagatgtggctgctgaagagctcatgaatgcattggtgaactcaactctactggagaccagaacaaccaatcagttcctagctgtctcaaagggaaactgctcagggcccactacaatcagaggtcaattctcaaacatgtcgctgtccctgttagacttgtatttaggtcgaggttacaatgtgtcatctatagtcactatgacatcccagggaatgtatgggggaacttacctagtggaaaagcctaatctgagcagcaaaaggtcagagttgtcacaactgagcatgtaccgagtgtttgaagtaggtgttatcagaaatccgggtttgggggctccggtgttccatatgacaaactatcttgagcaaccagtcagtaatgatctcagcaactgtatggtggctttgggggagctcaaactcgcagccctttgtcacggggaagattctatcacaattccctatcagggatcagggaaaggtgtcagcttccagctcgtcaagctaggtgtctggaaatccccaaccgacatgcaatcctgggtccccttatcaacggatgatccagtgatagacaggctttacctctcatctcacagaggtgttatcgctgacaatcaagcaaaatgggctgtcccgacaacacgaacagatgacaagttgcgaatggagacatgcttccaacaggcgtgtaagggtaaaatccaagcactctgcgagaatcccgagtgggcaccattgaaggataacaggattccttcatacggggtcttgtctgttgatctgagtctgacagttgagcttaaaatcaaaattgcttcgggattcgggccattgatcacacacggttcagggatggacctatacaaatccaaccacaacaatgtgtattggctgactatcccgccaatgaagaacctagccttaggtgtaatcaacacattggagtggataccgagattcaaggttagtccctacctcttcactgtcccaattaaggaagcaggcgaagactgccatgccccaacatacctacctgcggaggtggatggtgatgtcaaactcagttccaatctggtgattctacctggtcaagatctccaatatgttttggcaacctacgatacttccagggttgaacatgctgtggtttattacgtttacagcccaagccgctcattttcttacttttatccttttaggttgcctataaagggggtccccatcgaattacaagtggaatgcttcacatgggaccaaaaactctggtgccgtcacttctgtgtgcttgcggactcagaatctggtggacatatcactcactctgggatggtgggcatgggagtcagctgcacagtcacccgggaagatggaaccaatcgcagatagggctgctagtgaaccaatcacatgatgtcacccagacatcaggcatacccactagtgtgaaatagacatcagaattaagaaaaacgtagggtccaagtggttccccgttatggactcgctatctgtcaaccagatcttataccctgaagttcacctagatagcccgatagttaccaataagatagtagccatcctggagtatgctcgagtccctcacgcttacagcctggaggaccctacactgtgtcagaacatcaagcaccgcctaaaaaacggattttccaaccaaatgattataaacaatgtggaagttgggaatgtcatcaagtccaagcttaggagttatccggcccactctcatattccatatccaaattgtaatcaggatttatttaacatagaagacaaagagtcaacgaggaagatccgtgaactcctcaaaaaggggaattcgctgtactccaaagtcagtgataaggttttccaatgcttaagggacactaactcacggcttggcctaggctccgaattgagggaggacatcaaggagaaagttattaacttgggagtttacatgcacagctcccagtggtttgagccctttctgttttggtttacagtcaagactgagatgaggtcagtgattaaatcacaaacccatacttgccataggaggagacacacacctgtattcttcactggtagttcagttgagttgctaatctctcgtgaccttgttgctataatcagtaaagagtctcaacatgtatattacctgacatttgaactggttttgatgtattgtgatgtcatagaggggaggttaatgacagagaccgctatgactattgatgctaggtatacagagcttctaggaagagtcagatacatgtggaaactgatagatggtttcttccctgcactcgggaatccaacttatcaaattgtagccatgctggagcctctttcacttgcttacctgcagctgagggatataacagtagaactcagaggtgctttccttaaccactgctttactgaaatacatgatgttcttgaccaaaacgggttttctgatgaaggtacttatcatgagttaactgaagctctagattacattttcataactgatgacatacatctgacaggggagattttctcatttttcagaagtttcggccaccccagacttgaagcagtaacggctgctgaaaatgttaggaaatacatgaatcagcctaaagtcattgtgtatgagactctgatgaaaggtcatgccatattttgtggaatcataatcaacggctatcgtgacaggcacggaggcagttggccaccgctgaccctccccctgcatgctgcagacacaatccggaatgctcaagcttcaggtgaagggttaacacatgagcagtgcgttgataactggaaatcttttgctggagtgaaatttggctgctttatgcctcttagcctggatagtgatctgacaatgtacctaaaggacaaggcacttgctgctctccaaagggaatgggattcagtttacccgaaagagttcctgcgttacgaccctcccaagggaaccgggtcacggaggcttgtagatgttttccttaatgattcgagctttgacccatatgatgtgataatgtatgttgtaagtggagcttacctccatgaccctgagttcaacctgtcttacagcctgaaagaaaaggagatcaaggaaacaggtagactttttgctaaaatgacttacaaaatgagggcatgccaagtgattgctgaaaatctaatctcaaacgggattggcaaatattttaaggacaatgggatggccaaggatgagcacgatttgactaaggcactccacactctagctgtctcaggagtccccaaagatctcaaagaaagtcacaggggggggccagtcttaaaaacctactcccgaagcccagtccacacaagtaccaggaacgtgagagcagcaaaagggtttatagggttccctcaagtaattcggcaggaccaagacactgatcatccggagaatatggaagcttacgagacagtcagtgcatttatcacgactgatctcaagaagtactgccttaattggagatatgagaccatcagcttgtttgcacagaggctaaatgagatttacggattgccctcatttttccagtggctgcataagaggcttgagacctctgtcctgtatgtaagtgaccctcattgcccccccgaccttgacgcccatatcccgttatataaagtccccaatgatcaaatcttcattaagtaccctatgggaggtatagaagggtattgtcagaagctgtggaccatcagcaccattccctatctatacctggctgcttatgagagcggagtaaggattgcttcgttagtgcaaggggacaatcagaccatagccgtaacaaaaagggtacccagcacatggccctacaaccttaagaaacgggaagctgctagagtaactagagattactttgtaattcttaggcaaaggctacatgatattggccatcacctcaaggcaaatgagacaattgtttcatcacatttttttgtctattcaaaaggaatatattatgatgggctacttgtgtcccaatcactcaagagcatcgcaagatgtgtattctggtcagagactatagttgatgaaacaagggcagcatgcagtaatattgctacaacaatggctaaaagcatcgagagaggttatgaccgttaccttgcatattccctgaacgtcctaaaagtgatacagcaaattctgatctctcttggcttcacaatcaattcaaccatgacccgggatgtagtcatacccctcctcacaaacaacgacctcttaataaggatggcactgttgcccgctcctattggggggatgaattatctgaatatgagcaggctgtttgtcagaaacatcggtgatccagtaacatcatcaattgctgatctcaagagaatgattctcgcctcactaatgcctgaagagaccctccatcaagtaatgacacaacaaccgggggactcttcattcctagactgggctagcgacccttactcagcaaatcttgtatgtgtccagagcatcactagactcctcaagaacataactgcaaggtttgtcctgatccatagtccaaacccaatgttaaaaggattattccatgatgacagtaaagaagaggacgagggactggcggcattcctcatggacaggcatattatagtacctagggcagctcatgaaatcctggatcatagtgtcacaggggcaagagagtctattgcaggcatgctggataccacaaaaggcttgattcgagccagcatgaggaagggggggttaacctctcgagtgataaccagattgtccaattatgactatgaacaattcagagcagggatggtgctattgacaggaagaaagagaaatgtcctcattgacaaagagtcatgttcagtgcagctggcgagagctctaagaagccatatgtgggcgaggctagctcgaggacggcctatttacggccttgaggtccctgatgtactagaatctatgcgaggccaccttattcggcgtcatgagacatgtgtcatctgcgagtgtggatcagtcaactacggatggttttttgtcccctcgggttgccaactggatgatattgacaaggaaacatcatccttgagagtcccatatattggttctaccactgatgagagaacagacatgaagcttgccttcgtaagagccccaagtcgatccttgcgatctgctgttagaatagcaacagtgtactcatgggcttacggtgatgatgatagctcttggaacgaagcctggttgttggctaggcaaagggccaatgtgagcctggaggagctaagggtgatcactcccatctcaacttcgactaatttagcgcataggttgagggatcgtagcactcaagtgaaatactcaggtacatcccttgtccgagtggcgaggtataccacaatctccaacgacaatctctcatttgtcatatcagataagaaggttgatactaactttatataccaacaaggaatgcttctagggttgggtgttttagaaacattgtttcgactcgagaaagataccggatcatctaacacggtattacatcttcacgtcgaaacagattgttgcgtgatcccgatgatagatcatcccaggatacccagctcccgcaagctagagctgagggcagagctatgtaccaacccattgatatatgataatgcacctttaattgacagagatgcaacaaggctatacacccagagccataggaggcaccttgtggaatttgttacatggtccacaccccaactatatcacattttagctaagtccacagcactatctatgattgacctggtaacaaaatttgagaaggaccatatgaatgaaatttcagctctcataggggatgacgatatcaatagtttcataactgagtttctgctcatagagccaagattattcactatctacttgggccagtgtgcggccatcaattgggcatttgatgtacattatcatagaccatcagggaaatatcagatgggtgagctgttgtcatcgttcctttctagaatgagcaaaggagtgtttaaggtgcttgtcaatgctctaagccacccaaagatctacaagaaattctggcattgtggtattatagagcctatccatggtccttcacttgatgctcaaaacttgcacacaactgtgtgcaacatggtttacacatgctatatgacctacctcgacctgttgttgaatgaagagttagaagagttcacatttctcttgtgtgaaagcgacgaggatgtagtaccggacagattcgacaacatccaggcaaaacacttatgtgttctggcagatttgtactgtcaaccagggacctgcccaccaattcgaggtctaagaccggtagagaaatgtgcagttctaaccgaccatatcaaggcagaggctatgttatctccagcaggatcttcgtggaacataaatccaattattgtagaccattactcatgctctctgacttatctccggcgaggatcgatcaaacagataagattgagagttgatccaggattcattttcgacgccctcgctgaggtaaatgtcagtcagccaaagatcggcagcaacaacatctcaaatatgagcatcaaggctttcagacccccacacgatgatgttgcaaaattgctcaaagatatcaacacaagcaagcacaatcttcccatttcagggggcaatctcgccaattatgaaatccatgctttccgcagaatcgggttgaactcatctgcttgctacaaagctgttgagatatcaacattaattaggagatgccttgagccaggggaggacggcttgttcttgggtgagggatcgggttctatgttgatcacttataaagagatacttaaactaaacaagtgcttctataatagtggggtttccgccaattctagatctggtcaaagggaattagcaccctatccctccgaagttggccttgtcgaacacagaatgggagtaggtaatattgtcaaagtgctctttaacgggaggcccgaagtcacgtgggtaggcagtgtagattgcttcaatttcatagttagtaatatccctacctctagtgtggggtttatccattcagatatagagaccttgcctgacaaagatactatagagaagctagaggaattggcagccatcttatcgatggctctgctcctgggcaaaataggatcaatactggtgattaagcttatgcctttcagcggggattttgttcagggatttataagttatgtagggtctcattatagagaagtgaaccttgtataccctagatacagcaacttcatctctactgaatcttatttggttatgacagatctcaaggctaaccggctaatgaatcctgaaaagattaagcagcagataattgaatcatctgtgaggacttcacctggacttataggtcacatcctatccattaagcaactaagctgcatacaagcaattgtgggagacgcagttagtagaggtgatatcaatcctactctgaaaaaacttacacctatagagcaggtgctgatcaattgcgggttggcaattaacggacctaagctgtgcaaagaattgatccaccatgatgttgcctcagggcaagatggattgcttaattctatactcatcctctacagggagttggcaagattcaaagacaaccaaagaagtcaacaagggatgttccacgcttaccccgtattggtaagtagcaggcaacgagaacttatatctaggatcacccgcaaattctgggggcacattcttctttactccgggaacaaaaagttgataaataagtttatccagaatctcaagtccggctatctgatactagacttacaccagaatatcttcgttaagaatctatccaagtcagagaaacagattattatgacggggggtttgaaacgtgagtgggtttttaaggtaacagtcaaggagaccaaagaatggtataagttagtcggatacagtgccctgattaaggactaattggttgaactccggaaccctaatcctgccctaggtggttaggcattatttgcaatatattaaagaaaactttgaaaatacgaagtttctattcccagctttgtctggtggccggcatggtcccagcctcctcgctggcgccggctgggcaacattccgaggggaccgtcccctcggtaatggcgaatgggacgcggccgatccggctgctaacaaagcccgaaaggaagctgagttggctgctgccaccgctgagcaataactagcataaccccttggggcctctaaacgggtcttgaggggttttttgctgaaaggaggaactatatccggatgcggccgcgggccctatggtacccagcttttgttccctttagtgagggttaattccgagcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctcggcccccctgacgagcatcacaaaaatcgacgctcaagtcagaggtggcgaaacccgacaggactataaagataccaggcgttcccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactgcccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgaaaaaaagcggttagctccttcggtcctccgatcgttgtcagaagtaagttggccgcagtgttatcactcatgcttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagccaccgcggtgatccttataaagctagatg

SEQ ID NO: 59 - DNA, 18994 bp, Measles virus
  Schwarz strain pTM - pTM MV Schw
tcatgaacgcggccgctaatacgactcactatagggccaactttgtttggtctgatgagtccgtgaggacgaaacccggagtcccgggtcaccaaacaaagttgggtaaggatagttcaatcaatgatcatcttctagtgcacttaggattcaagatcctattatcagggacaagagcaggattagggatatccgagatggccacacttttaaggagcttagcattgttcaaaagaaacaaggacaaaccacccattacatcaggatccggtggagccatcagaggaatcaaacacattattatagtaccaatccctggagattcctcaattaccactcgatccagacttctggaccggttggtgaggttaattggaaacccggatgtgagcgggcccaaactaacaggggcactaataggtatattatccttatttgtggagtctccaggtcaattgattcagaggatcaccgatgaccctgacgttagcataaggctgttagaggttgtccagagtgaccagtcacaatctggccttaccttcgcatcaagaggtaccaacatggaggatgaggcggaccaatacttttcacatgatgatccaattagtagtgatcaatccaggttcggatggttcgggaacaaggaaatctcagatattgaagtgcaagaccctgagggattcaacatgattctgggtaccatcctagcccaaatttgggtcttgctcgcaaaggcggttacggccccagacacggcagctgattcggagctaagaaggtggataaagtacacccaacaaagaagggtagttggtgaatttagattggagagaaaatggttggatgtggtgaggaacaggattgccgaggacctctccttacgccgattcatggtcgctctaatcctggatatcaagagaacacccggaaacaaacccaggattgctgaaatgatatgtgacattgatacatatatcgtagaggcaggattagccagttttatcctgactattaagtttgggatagaaactatgtatcctgctcttggactgcatgaatttgctggtgagttatccacacttgagtccttgatgaacctttaccagcaaatgggggaaactgcaccctacatggtaatcctggagaactcaattcagaacaagttcagtgcaggatcataccctctgctctggagctatgccatgggagtaggagtggaacttgaaaactccatgggaggtttgaactttggccgatcttactttgatccagcatattttagattagggcaagagatggtaaggaggtcagctggaaaggtcagttccacattggcatctgaactcggtatcactgccgaggatgcaaggcttgtttcagagattgcaatgcatactactgaggacaagatcagtagagcggttggacccagacaagcccaagtatcatttctacacggtgatcaaagtgagaatgagctaccgagattggggggcaaggaagataggagggtcaaacagagtcgaggagaagccagggagagctacagagaaaccgggcccagcagagcaagtgatgcgagagctgcccatcttccaaccggcacacccctagacattgacactgcaacggagtccagccaagatccgcaggacagtcgaaggtcagctgacgccctgcttaggctgcaagccatggcaggaatctcggaagaacaaggctcagacacggacacccctatagtgtacaatgacagaaatcttctagactaggtgcgagaggccgagggccagaacaacatccgcctaccatccatcattgttataaaaaacttaggaaccaggtccacacagccgccagcccatcaaccatccactcccacgattggagccaatggcagaagagcaggcacgccatgtcaaaaacggactggaatgcatccgggctctcaaggccgagcccatcggctcactggccatcgaggaagctatggcagcatggtcagaaatatcagacaacccaggacaggagcgagccacctgcagggaagagaaggcaggcagttcgggtctcagcaaaccatgcctctcagcaattggatcaactgaaggcggtgcacctcgcatccgcggtcagggacctggagagagcgatgacgacgctgaaactttgggaatccccccaagaaatctccaggcatcaagcactgggttacagtgttattacgtttatgatcacagcggtgaagcggttaagggaatccaagatgctgactctatcatggttcaatcaggccttgatggtgatagcaccctctcaggaggagacaatgaatctgaaaacagcgatgtggatattggcgaacctgataccgagggatatgctatcactgaccggggatctgctcccatctctatggggttcagggcttctgatgttgaaactgcagaaggaggggagatccacgagctcctgagactccaatccagaggcaacaactttccgaagcttgggaaaactctcaatgttcctccgcccccggaccccggtagggccagcacttccgggacacccattaaaaagggcacagacgcgagattagcctcatttggaacggagatcgcgtctttattgacaggtggtgcaacccaatgtgctcgaaagtcaccctcggaaccatcagggccaggtgcacctgcggggaatgtccccgagtgtgtgagcaatgccgcactgatacaggagtggacacccgaatctggtaccacaatctccccgagatcccagaataatgaagaagggggagactattatgatgatgagctgttctctgatgtccaagatattaaaacagccttggccaaaatacacgaggataatcagaagataatctccaagctagaatcactgctgttattgaagggagaagttgagtcaattaagaagcagatcaacaggcaaaatatcagcatatccaccctggaaggacacctctcaagcatcatgatcgccattcctggacttgggaaggatcccaacgaccccactgcagatgtcgaaatcaatcccgacttgaaacccatcataggcagagattcaggccgagcactggccgaagttctcaagaaacccgttgccagccgacaactccaaggaatgacaaatggacggaccagttccagaggacagctgctgaaggaatttcagctaaagccgatcgggaaaaagatgagctcagccgtcgggtttgttcctgacaccggccctgcatcacgcagtgtaatccgctccattataaaatccagccggctagaggaggatcggaagcgttacctgatgactctccttgatgatatcaaaggagccaatgatcttgccaagttccaccagatgctgatgaagataataatgaagtagctacagctcaacttacctgccaaccccatgccagtcgacccaactagtacaacctaaatccattataaaaaacttaggagcaaagtgattgcctcccaaggtccacaatgacagagacctacgacttcgacaagtcggcatgggacatcaaagggtcgatcgctccgatacaacccaccacctacagtgatggcaggctggtgccccaggtcagagtcatagatcctggtctaggcgacaggaaggatgaatgctttatgtacatgtttctgctgggggttgttgaggacagcgattccctagggcctccaatcgggcgagcatttgggttcctgcccttaggtgttggcagatccacagcaaagcccgaaaaactcctcaaagaggccactgagcttgacatagttgttagacgtacagcagggctcaatgaaaaactggtgttctacaacaacaccccactaactctcctcacaccttggagaaaggtcctaacaacagggagtgtcttcaacgcaaaccaagtgtgcaatgcggttaatctgataccgctcgataccccgcagaggttccgtgttgtttatatgagcatcacccgtctttcggataacgggtattacaccgttcctagaagaatgctggaattcagatcggtcaatgcagtggccttcaacctgctggtgacccttaggattgacaaggcgataggccctgggaagatcatcgacaatacagagcaacttcctgaggcaacatttatggtccacatcgggaacttcaggagaaagaagagtgaagtctactctgccgattattgcaaaatgaaaatcgaaaagatgggcctggtttttgcacttggtgggatagggggcaccagtcttcacattagaagcacaggcaaaatgagcaagactctccatgcacaactcgggttcaagaagaccttatgttacccgctgatggatatcaatgaagaccttaatcgattactctggaggagcagatgcaagatagtaagaatccaggcagttttgcagccatcagttcctcaagaattccgcatttacgacgacgtgatcataaatgatgaccaaggactattcaaagttctgtagaccgtagtgcccagcaatgcccgaaaacgacccccctcacaatgacagccagaaggcccggacaaaaaagccccctccgaaagactccacggaccaagcgagaggccagccagcagccgacggcaagcgcgaacaccaggcggccccagcacagaacagccctgacacaaggccaccaccagccaccccaatctgcatcctcctcgtgggacccccgaggaccaacccccaaggctgcccccgatccaaaccaccaaccgcatccccaccacccccgggaaagaaacccccagcaattggaaggcccctccccctcttcctcaacacaagaactccacaaccgaaccgcacaagcgaccgaggtgacccaaccgcaggcatccgactccctagacagatcctctctccccggcaaactaaacaaaacttagggccaaggaacatacacacccaacagaacccagaccccggcccacggcgccgcgcccccaacccccgacaaccagagggagcccccaaccaatcccgccggctcccccggtgcccacaggcagggacaccaacccccgaacagacccagcacccaaccatcgacaatccaagacgggggggcccccccaaaaaaaggcccccaggggccgacagccagcaccgcgaggaagcccacccaccccacacacgaccacggcaaccaaaccagaacccagaccaccctgggccaccagctcccagactcggccatcaccccgcagaaaggaaaggccacaacccgcgcaccccagccccgatccggcggggagccacccaacccgaaccagcacccaagagcgatccccgaaggacccccgaaccgcaaaggacatcagtatcccacagcctctccaagtcccccggtctcctcctcttctcgaagggaccaaaagatcaatccaccacacccgacgacactcaactccccacccctaaaggagacaccgggaatcccagaatcaagactcatccaatgtccatcatgggtctcaaggtgaacgtctctgccatattcatggcagtactgttaactctccaaacacccaccggtcaaatccattggggcaatctctctaagataggggtggtaggaataggaagtgcaagctacaaagttatgactcgttccagccatcaatcattagtcataaaattaatgcccaatataactctcctcaataactgcacgagggtagagattgcagaatacaggagactactgagaacagttttggaaccaattagagatgcacttaatgcaatgacccagaatataagaccggttcagagtgtagcttcaagtaggagacacaagagatttgcgggagtagtcctggcaggtgcggccctaggcgttgccacagctgctcagataacagccggcattgcacttcaccagtccatgctgaactctcaagccatcgacaatctgagagcgagcctggaaactactaatcaggcaattgagacaatcagacaagcagggcaggagatgatattggctgttcagggtgtccaagactacatcaataatgagctgataccgtctatgaaccaactatcttgtgatttaatcggccagaagctcgggctcaaattgctcagatactatacagaaatcctgtcattatttggccccagtttacgggaccccatatctgcggagatatctatccaggctttgagctatgcgcttggaggagacatcaataaggtgttagaaaagctcggatacagtggaggtgatttactgggcatcttagagagcggaggaataaaggcccggataactcacgtcgacacagagtcctacttcattgtcctcagtatagcctatccgacgctgtccgagattaagggggtgattgtccaccggctagagggggtctcgtacaacataggctctcaagagtggtataccactgtgcccaagtatgttgcaacccaagggtaccttatctcgaattttgatgagtcatcgtgtactttcatgccagaggggactgtgtgcagccaaaatgccttgtacccgatgagtcctctgctccaagaatgcctccgggggtacaccaagtcctgtgctcgtacactcgtatccgggtcttttgggaaccggttcattttatcacaagggaacctaatagccaattgtgcatcaatcctttgcaagtgttacacaacaggaacgatcattaatcaagaccctgacaagatcctaacatacattgctgccgatcactgcccggtagtcgaggtgaacggcgtgaccatccaagtcgggagcaggaggtatccagacgctgtgtacttgcacagaattgacctcggtcctcccatatcattggagaggttggacgtagggacaaatctggggaatgcaattgctaagttggaggatgccaaggaattgttggagtcatcggaccagatattgaggagtatgaaaggtttatcgagcactagcatagtctacatcctgattgcagtgtgtcttggagggttgatagggatccccgctttaatatgttgctgcagggggcgttgtaacaaaaagggagaacaagttggtatgtcaagaccaggcctaaagcctgatcttacgggaacatcaaaatcctatgtaaggtcgctctgatcctctacaactcttgaaacacaaatgtcccacaagtctcctcttcgtcatcaagcaaccaccgcacccagcatcaagcccacctgaaattatctccggcttccctctggccgaacaatatcggtagttaatcaaaacttagggtgcaagatcatccacaatgtcaccacaacgagaccggataaatgccttctacaaagataacccccatcccaagggaagtaggatagtcattaacagagaacatcttatgattgatagaccttatgttttgctggctgttctgtttgtcatgtttctgagcttgatcgggttgctagccattgcaggcattagacttcatcgggcagccatctacaccgcagagatccataaaagcctcagcaccaatctagatgtaactaactcaatcgagcatcaggtcaaggacgtgctgacaccactcttcaaaatcatcggtgatgaagtgggcctgaggacacctcagagattcactgacctagtgaaattaatctctgacaagattaaattccttaatccggatagggagtacgacttcagagatctcacttggtgtatcaacccgccagagagaatcaaattggattatgatcaatactgtgcagatgtggctgctgaagagctcatgaatgcattggtgaactcaactctactggagaccagaacaaccaatcagttcctagctgtctcaaagggaaactgctcagggcccactacaatcagaggtcaattctcaaacatgtcgctgtccctgttagacttgtatttaggtcgaggttacaatgtgtcatctatagtcactatgacatcccagggaatgtatgggggaacttacctagtggaaaagcctaatctgagcagcaaaaggtcagagttgtcacaactgagcatgtaccgagtgtttgaagtaggtgttatcagaaatccgggtttgggggctccggtgttccatatgacaaactatcttgagcaaccagtcagtaatgatctcagcaactgtatggtggctttgggggagctcaaactcgcagccctttgtcacggggaagattctatcacaattccctatcagggatcagggaaaggtgtcagcttccagctcgtcaagctaggtgtctggaaatccccaaccgacatgcaatcctgggtccccttatcaacggatgatccagtgatagacaggctttacctctcatctcacagaggtgttatcgctgacaatcaagcaaaatgggctgtcccgacaacacgaacagatgacaagttgcgaatggagacatgcttccaacaggcgtgtaagggtaaaatccaagcactctgcgagaatcccgagtgggcaccattgaaggataacaggattccttcatacggggtcttgtctgttgatctgagtctgacagttgagcttaaaatcaaaattgcttcgggattcgggccattgatcacacacggttcagggatggacctatacaaatccaaccacaacaatgtgtattggctgactatcccgccaatgaagaacctagccttaggtgtaatcaacacattggagtggataccgagattcaaggttagtccctacctcttcactgtcccaattaaggaagcaggcgaagactgccatgccccaacatacctacctgcggaggtggatggtgatgtcaaactcagttccaatctggtgattctacctggtcaagatctccaatatgttttggcaacctacgatacttccagggttgaacatgctgtggtttattacgtttacagcccaagccgctcattttcttacttttatccttttaggttgcctataaagggggtccccatcgaattacaagtggaatgcttcacatgggaccaaaaactctggtgccgtcacttctgtgtgcttgcggactcagaatctggtggacatatcactcactctgggatggtgggcatgggagtcagctgcacagtcacccgggaagatggaaccaatcgcagatagggctgctagtgaaccaatcacatgatgtcacccagacatcaggcatacccactagtgtgaaatagacatcagaattaagaaaaacgtagggtccaagtggttccccgttatggactcgctatctgtcaaccagatcttataccctgaagttcacctagatagcccgatagttaccaataagatagtagccatcctggagtatgctcgagtccctcacgcttacagcctggaggaccctacactgtgtcagaacatcaagcaccgcctaaaaaacggattttccaaccaaatgattataaacaatgtggaagttgggaatgtcatcaagtccaagcttaggagttatccggcccactctcatattccatatccaaattgtaatcaggatttatttaacatagaagacaaagagtcaacgaggaagatccgtgaactcctcaaaaaggggaattcgctgtactccaaagtcagtgataaggttttccaatgcttaagggacactaactcacggcttggcctaggctccgaattgagggaggacatcaaggagaaagttattaacttgggagtttacatgcacagctcccagtggtttgagccctttctgttttggtttacagtcaagactgagatgaggtcagtgattaaatcacaaacccatacttgccataggaggagacacacacctgtattcttcactggtagttcagttgagttgctaatctctcgtgaccttgttgctataatcagtaaagagtctcaacatgtatattacctgacatttgaactggttttgatgtattgtgatgtcatagaggggaggttaatgacagagaccgctatgactattgatgctaggtatacagagcttctaggaagagtcagatacatgtggaaactgatagatggtttcttccctgcactcgggaatccaacttatcaaattgtagccatgctggagcctctttcacttgcttacctgcagctgagggatataacagtagaactcagaggtgctttccttaaccactgctttactgaaatacatgatgttcttgaccaaaacgggttttctgatgaaggtacttatcatgagttaactgaagctctagattacattttcataactgatgacatacatctgacaggggagattttctcatttttcagaagtttcggccaccccagacttgaagcagtaacggctgctgaaaatgttaggaaatacatgaatcagcctaaagtcattgtgtatgagactctgatgaaaggtcatgccatattttgtggaatcataatcaacggctatcgtgacaggcacggaggcagttggccaccgctgaccctccccctgcatgctgcagacacaatccggaatgctcaagcttcaggtgaagggttaacacatgagcagtgcgttgataactggaaatcttttgctggagtgaaatttggctgctttatgcctcttagcctggatagtgatctgacaatgtacctaaaggacaaggcacttgctgctctccaaagggaatgggattcagtttacccgaaagagttcctgcgttacgaccctcccaagggaaccgggtcacggaggcttgtagatgttttccttaatgattcgagctttgacccatatgatgtgataatgtatgttgtaagtggagcttacctccatgaccctgagttcaacctgtcttacagcctgaaagaaaaggagatcaaggaaacaggtagactttttgctaaaatgacttacaaaatgagggcatgccaagtgattgctgaaaatctaatctcaaacgggattggcaaatattttaaggacaatgggatggccaaggatgagcacgatttgactaaggcactccacactctagctgtctcaggagtccccaaagatctcaaagaaagtcacaggggggggccagtcttaaaaacctactcccgaagcccagtccacacaagtaccaggaacgtgagagcagcaaaagggtttatagggttccctcaagtaattcggcaggaccaagacactgatcatccggagaatatggaagcttacgagacagtcagtgcatttatcacgactgatctcaagaagtactgccttaattggagatatgagaccatcagcttgtttgcacagaggctaaatgagatttacggattgccctcatttttccagtggctgcataagaggcttgagacctctgtcctgtatgtaagtgaccctcattgcccccccgaccttgacgcccatatcccgttatataaagtccccaatgatcaaatcttcattaagtaccctatgggaggtatagaagggtattgtcagaagctgtggaccatcagcaccattccctatctatacctggctgcttatgagagcggagtaaggattgcttcgttagtgcaaggggacaatcagaccatagccgtaacaaaaagggtacccagcacatggccctacaaccttaagaaacgggaagctgctagagtaactagagattactttgtaattcttaggcaaaggctacatgatattggccatcacctcaaggcaaatgagacaattgtttcatcacatttttttgtctattcaaaaggaatatattatgatgggctacttgtgtcccaatcactcaagagcatcgcaagatgtgtattctggtcagagactatagttgatgaaacaagggcagcatgcagtaatattgctacaacaatggctaaaagcatcgagagaggttatgaccgttaccttgcatattccctgaacgtcctaaaagtgatacagcaaattctgatctctcttggcttcacaatcaattcaaccatgacccgggatgtagtcatacccctcctcacaaacaacgacctcttaataaggatggcactgttgcccgctcctattggggggatgaattatctgaatatgagcaggctgtttgtcagaaacatcggtgatccagtaacatcatcaattgctgatctcaagagaatgattctcgcctcactaatgcctgaagagaccctccatcaagtaatgacacaacaaccgggggactcttcattcctagactgggctagcgacccttactcagcaaatcttgtatgtgtccagagcatcactagactcctcaagaacataactgcaaggtttgtcctgatccatagtccaaacccaatgttaaaaggattattccatgatgacagtaaagaagaggacgagggactggcggcattcctcatggacaggcatattatagtacctagggcagctcatgaaatcctggatcatagtgtcacaggggcaagagagtctattgcaggcatgctggataccacaaaaggcttgattcgagccagcatgaggaagggggggttaacctctcgagtgataaccagattgtccaattatgactatgaacaattcagagcagggatggtgctattgacaggaagaaagagaaatgtcctcattgacaaagagtcatgttcagtgcagctggcgagagctctaagaagccatatgtgggcgaggctagctcgaggacggcctatttacggccttgaggtccctgatgtactagaatctatgcgaggccaccttattcggcgtcatgagacatgtgtcatctgcgagtgtggatcagtcaactacggatggttttttgtcccctcgggttgccaactggatgatattgacaaggaaacatcatccttgagagtcccatatattggttctaccactgatgagagaacagacatgaagcttgccttcgtaagagccccaagtcgatccttgcgatctgctgttagaatagcaacagtgtactcatgggcttacggtgatgatgatagctcttggaacgaagcctggttgttggctaggcaaagggccaatgtgagcctggaggagctaagggtgatcactcccatctcaacttcgactaatttagcgcataggttgagggatcgtagcactcaagtgaaatactcaggtacatcccttgtccgagtggcgaggtataccacaatctccaacgacaatctctcatttgtcatatcagataagaaggttgatactaactttatataccaacaaggaatgcttctagggttgggtgttttagaaacattgtttcgactcgagaaagataccggatcatctaacacggtattacatcttcacgtcgaaacagattgttgcgtgatcccgatgatagatcatcccaggatacccagctcccgcaagctagagctgagggcagagctatgtaccaacccattgatatatgataatgcacctttaattgacagagatgcaacaaggctatacacccagagccataggaggcaccttgtggaatttgttacatggtccacaccccaactatatcacattttagctaagtccacagcactatctatgattgacctggtaacaaaatttgagaaggaccatatgaatgaaatttcagctctcataggggatgacgatatcaatagtttcataactgagtttctgctcatagagccaagattattcactatctacttgggccagtgtgcggccatcaattgggcatttgatgtacattatcatagaccatcagggaaatatcagatgggtgagctgttgtcatcgttcctttctagaatgagcaaaggagtgtttaaggtgcttgtcaatgctctaagccacccaaagatctacaagaaattctggcattgtggtattatagagcctatccatggtccttcacttgatgctcaaaacttgcacacaactgtgtgcaacatggtttacacatgctatatgacctacctcgacctgttgttgaatgaagagttagaagagttcacatttctcttgtgtgaaagcgacgaggatgtagtaccggacagattcgacaacatccaggcaaaacacttatgtgttctggcagatttgtactgtcaaccagggacctgcccaccaattcgaggtctaagaccggtagagaaatgtgcagttctaaccgaccatatcaaggcagaggctatgttatctccagcaggatcttcgtggaacataaatccaattattgtagaccattactcatgctctctgacttatctccggcgaggatcgatcaaacagataagattgagagttgatccaggattcattttcgacgccctcgctgaggtaaatgtcagtcagccaaagatcggcagcaacaacatctcaaatatgagcatcaaggctttcagacccccacacgatgatgttgcaaaattgctcaaagatatcaacacaagcaagcacaatcttcccatttcagggggcaatctcgccaattatgaaatccatgctttccgcagaatcgggttgaactcatctgcttgctacaaagctgttgagatatcaacattaattaggagatgccttgagccaggggaggacggcttgttcttgggtgagggatcgggttctatgttgatcacttataaagagatacttaaactaaacaagtgcttctataatagtggggtttccgccaattctagatctggtcaaagggaattagcaccctatccctccgaagttggccttgtcgaacacagaatgggagtaggtaatattgtcaaagtgctctttaacgggaggcccgaagtcacgtgggtaggcagtgtagattgcttcaatttcatagttagtaatatccctacctctagtgtggggtttatccattcagatatagagaccttgcctgacaaagatactatagagaagctagaggaattggcagccatcttatcgatggctctgctcctgggcaaaataggatcaatactggtgattaagcttatgcctttcagcggggattttgttcagggatttataagttatgtagggtctcattatagagaagtgaaccttgtataccctagatacagcaacttcatctctactgaatcttatttggttatgacagatctcaaggctaaccggctaatgaatcctgaaaagattaagcagcagataattgaatcatctgtgaggacttcacctggacttataggtcacatcctatccattaagcaactaagctgcatacaagcaattgtgggagacgcagttagtagaggtgatatcaatcctactctgaaaaaacttacacctatagagcaggtgctgatcaattgcgggttggcaattaacggacctaagctgtgcaaagaattgatccaccatgatgttgcctcagggcaagatggattgcttaattctatactcatcctctacagggagttggcaagattcaaagacaaccaaagaagtcaacaagggatgttccacgcttaccccgtattggtaagtagcaggcaacgagaacttatatctaggatcacccgcaaattctgggggcacattcttctttactccgggaacaaaaagttgataaataagtttatccagaatctcaagtccggctatctgatactagacttacaccagaatatcttcgttaagaatctatccaagtcagagaaacagattattatgacggggggtttgaaacgtgagtgggtttttaaggtaacagtcaaggagaccaaagaatggtataagttagtcggatacagtgccctgattaaggactaattggttgaactccggaaccctaatcctgccctaggtggttaggcattatttgcaatatattaaagaaaactttgaaaatacgaagtttctattcccagctttgtctggtggccggcatggtcccagcctcctcgctggcgccggctgggcaacattccgaggggaccgtcccctcggtaatggcgaatgggacgcggccgatccggctgctaacaaagcccgaaaggaagctgagttggctgctgccaccgctgagcaataactagcataaccccttggggcctctaaacgggtcttgaggggttttttgctgaaaggaggaactatatccggatgcggccgcgggccctatggtacccagcttttgttccctttagtgagggttaattccgagcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctcggcccccctgacgagcatcacaaaaatcgacgctcaagtcagaggtggcgaaacccgacaggactataaagataccaggcgttcccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactgcccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgaaaaaaagcggttagctccttcggtcctccgatcgttgtcagaagtaagttggccgcagtgttatcactcatgcttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagccaccgcggtgatccttataaagctagatg

SEQ ID NO: 60 - DNA, 19107 bp, Artificial sequence
  pTM 2ATU MV Schw - Measles virus scaffold with ATU
tccaaccgcgcgcgcggccgctaatacgactcactatagggccaactttgtttggtctgatgagtccgtgaggacgaaacccggagtcccgggtcaccaaacaaagttgggtaaggatagttcaatcaatgatcatcttctagtgcacttaggattcaagatcctattatcagggacaagagcaggattagggatatccgagatggccacacttttaaggagcttagcattgttcaaaagaaacaaggacaaaccacccattacatcaggatccggtggagccatcagaggaatcaaacacattattatagtaccaatccctggagattcctcaattaccactcgatccagacttctggaccggttggtgaggttaattggaaacccggatgtgagcgggcccaaactaacaggggcactaataggtatattatccttatttgtggagtctccaggtcaattgattcagaggatcaccgatgaccctgacgttagcataaggctgttagaggttgtccagagtgaccagtcacaatctggccttaccttcgcatcaagaggtaccaacatggaggatgaggcggaccaatacttttcacatgatgatccaattagtagtgatcaatccaggttcggatggttcgggaacaaggaaatctcagatattgaagtgcaagaccctgagggattcaacatgattctgggtaccatcctagcccaaatttgggtcttgctcgcaaaggcggttacggccccagacacggcagctgattcggagctaagaaggtggataaagtacacccaacaaagaagggtagttggtgaatttagattggagagaaaatggttggatgtggtgaggaacaggattgccgaggacctctccttacgccgattcatggtcgctctaatcctggatatcaagagaacacccggaaacaaacccaggattgctgaaatgatatgtgacattgatacatatatcgtagaggcaggattagccagttttatcctgactattaagtttgggatagaaactatgtatcctgctcttggactgcatgaatttgctggtgagttatccacacttgagtccttgatgaacctttaccagcaaatgggggaaactgcaccctacatggtaatcctggagaactcaattcagaacaagttcagtgcaggatcataccctctgctctggagctatgccatgggagtaggagtggaacttgaaaactccatgggaggtttgaactttggccgatcttactttgatccagcatattttagattagggcaagagatggtaaggaggtcagctggaaaggtcagttccacattggcatctgaactcggtatcactgccgaggatgcaaggcttgtttcagagattgcaatgcatactactgaggacaagatcagtagagcggttggacccagacaagcccaagtatcatttctacacggtgatcaaagtgagaatgagctaccgagattggggggcaaggaagataggagggtcaaacagagtcgaggagaagccagggagagctacagagaaaccgggcccagcagagcaagtgatgcgagagctgcccatcttccaaccggcacacccctagacattgacactgcaacggagtccagccaagatccgcaggacagtcgaaggtcagctgacgccctgcttaggctgcaagccatggcaggaatctcggaagaacaaggctcagacacggacacccctatagtgtacaatgacagaaatcttctagactaggtgcgagaggccgagggccagaacaacatccgcctaccatccatcattgttataaaaaacttaggaaccaggtccacacagccgccagcccatcaaccatccactcccacgattggagccaatggcagaagagcaggcacgccatgtcaaaaacggactggaatgcatccgggctctcaaggccgagcccatcggctcactggccatcgaggaagctatggcagcatggtcagaaatatcagacaacccaggacaggagcgagccacctgcagggaagagaaggcaggcagttcgggtctcagcaaaccatgcctctcagcaattggatcaactgaaggcggtgcacctcgcatccgcggtcagggacctggagagagcgatgacgacgctgaaactttgggaatccccccaagaaatctccaggcatcaagcactgggttacagtgttattacgtttatgatcacagcggtgaagcggttaagggaatccaagatgctgactctatcatggttcaatcaggccttgatggtgatagcaccctctcaggaggagacaatgaatctgaaaacagcgatgtggatattggcgaacctgataccgagggatatgctatcactgaccggggatctgctcccatctctatggggttcagggcttctgatgttgaaactgcagaaggaggggagatccacgagctcctgagactccaatccagaggcaacaactttccgaagcttgggaaaactctcaatgttcctccgcccccggaccccggtagggccagcacttccgggacacccattaaaaagggcacagacgcgagattagcctcatttggaacggagatcgcgtctttattgacaggtggtgcaacccaatgtgctcgaaagtcaccctcggaaccatcagggccaggtgcacctgcggggaatgtccccgagtgtgtgagcaatgccgcactgatacaggagtggacacccgaatctggtaccacaatctccccgagatcccagaataatgaagaagggggagactattatgatgatgagctgttctctgatgtccaagatattaaaacagccttggccaaaatacacgaggataatcagaagataatctccaagctagaatcactgctgttattgaagggagaagttgagtcaattaagaagcagatcaacaggcaaaatatcagcatatccaccctggaaggacacctctcaagcatcatgatcgccattcctggacttgggaaggatcccaacgaccccactgcagatgtcgaaatcaatcccgacttgaaacccatcataggcagagattcaggccgagcactggccgaagttctcaagaaacccgttgccagccgacaactccaaggaatgacaaatggacggaccagttccagaggacagctgctgaaggaatttcagctaaagccgatcgggaaaaagatgagctcagccgtcgggtttgttcctgacaccggccctgcatcacgcagtgtaatccgctccattataaaatccagccggctagaggaggatcggaagcgttacctgatgactctccttgatgatatcaaaggagccaatgatcttgccaagttccaccagatgctgatgaagataataatgaagtagctacagctcaacttacctgccaaccccatgccagtcgacccaactagcctaccctccatcattgttataaaaaacttaggaaccaggtccacacagccgccagcccatcaacgcgtacggcgcgcagcgcttagacgtctcgcgatcgatactagtacaacctaaatccattataaaaaacttaggagcaaagtgattgcctcccaaggtccacaatgacagagacctacgacttcgacaagtcggcatgggacatcaaagggtcgatcgctccgatacaacccaccacctacagtgatggcaggctggtgccccaggtcagagtcatagatcctggtctaggcgacaggaaggatgaatgctttatgtacatgtttctgctgggggttgttgaggacagcgattccctagggcctccaatcgggcgagcatttgggttcctgcccttaggtgttggcagatccacagcaaagcccgaaaaactcctcaaagaggccactgagcttgacatagttgttagacgtacagcagggctcaatgaaaaactggtgttctacaacaacaccccactaactctcctcacaccttggagaaaggtcctaacaacagggagtgtcttcaacgcaaaccaagtgtgcaatgcggttaatctgataccgctcgataccccgcagaggttccgtgttgtttatatgagcatcacccgtctttcggataacgggtattacaccgttcctagaagaatgctggaattcagatcggtcaatgcagtggccttcaacctgctggtgacccttaggattgacaaggcgataggccctgggaagatcatcgacaatacagagcaacttcctgaggcaacatttatggtccacatcgggaacttcaggagaaagaagagtgaagtctactctgccgattattgcaaaatgaaaatcgaaaagatgggcctggtttttgcacttggtgggatagggggcaccagtcttcacattagaagcacaggcaaaatgagcaagactctccatgcacaactcgggttcaagaagaccttatgttacccgctgatggatatcaatgaagaccttaatcgattactctggaggagcagatgcaagatagtaagaatccaggcagttttgcagccatcagttcctcaagaattccgcatttacgacgacgtgatcataaatgatgaccaaggactattcaaagttctgtagaccgtagtgcccagcaatgcccgaaaacgacccccctcacaatgacagccagaaggcccggacaaaaaagccccctccgaaagactccacggaccaagcgagaggccagccagcagccgacggcaagcgcgaacaccaggcggccccagcacagaacagccctgacacaaggccaccaccagccaccccaatctgcatcctcctcgtgggacccccgaggaccaacccccaaggctgcccccgatccaaaccaccaaccgcatccccaccacccccgggaaagaaacccccagcaattggaaggcccctccccctcttcctcaacacaagaactccacaaccgaaccgcacaagcgaccgaggtgacccaaccgcaggcatccgactccctagacagatcctctctccccggcaaactaaacaaaacttagggccaaggaacatacacacccaacagaacccagaccccggcccacggcgccgcgcccccaacccccgacaaccagagggagcccccaaccaatcccgccggctcccccggtgcccacaggcagggacaccaacccccgaacagacccagcacccaaccatcgacaatccaagacgggggggcccccccaaaaaaaggcccccaggggccgacagccagcaccgcgaggaagcccacccaccccacacacgaccacggcaaccaaaccagaacccagaccaccctgggccaccagctcccagactcggccatcaccccgcagaaaggaaaggccacaacccgcgcaccccagccccgatccggcggggagccacccaacccgaaccagcacccaagagcgatccccgaaggacccccgaaccgcaaaggacatcagtatcccacagcctctccaagtcccccggtctcctcctcttctcgaagggaccaaaagatcaatccaccacacccgacgacactcaactccccacccctaaaggagacaccgggaatcccagaatcaagactcatccaatgtccatcatgggtctcaaggtgaacgtctctgccatattcatggcagtactgttaactctccaaacacccaccggtcaaatccattggggcaatctctctaagataggggtggtaggaataggaagtgcaagctacaaagttatgactcgttccagccatcaatcattagtcataaaattaatgcccaatataactctcctcaataactgcacgagggtagagattgcagaatacaggagactactgagaacagttttggaaccaattagagatgcacttaatgcaatgacccagaatataagaccggttcagagtgtagcttcaagtaggagacacaagagatttgcgggagtagtcctggcaggtgcggccctaggcgttgccacagctgctcagataacagccggcattgcacttcaccagtccatgctgaactctcaagccatcgacaatctgagagcgagcctggaaactactaatcaggcaattgagacaatcagacaagcagggcaggagatgatattggctgttcagggtgtccaagactacatcaataatgagctgataccgtctatgaaccaactatcttgtgatttaatcggccagaagctcgggctcaaattgctcagatactatacagaaatcctgtcattatttggccccagtttacgggaccccatatctgcggagatatctatccaggctttgagctatgcgcttggaggagacatcaataaggtgttagaaaagctcggatacagtggaggtgatttactgggcatcttagagagcggaggaataaaggcccggataactcacgtcgacacagagtcctacttcattgtcctcagtatagcctatccgacgctgtccgagattaagggggtgattgtccaccggctagagggggtctcgtacaacataggctctcaagagtggtataccactgtgcccaagtatgttgcaacccaagggtaccttatctcgaattttgatgagtcatcgtgtactttcatgccagaggggactgtgtgcagccaaaatgccttgtacccgatgagtcctctgctccaagaatgcctccgggggtacaccaagtcctgtgctcgtacactcgtatccgggtcttttgggaaccggttcattttatcacaagggaacctaatagccaattgtgcatcaatcctttgcaagtgttacacaacaggaacgatcattaatcaagaccctgacaagatcctaacatacattgctgccgatcactgcccggtagtcgaggtgaacggcgtgaccatccaagtcgggagcaggaggtatccagacgctgtgtacttgcacagaattgacctcggtcctcccatatcattggagaggttggacgtagggacaaatctggggaatgcaattgctaagttggaggatgccaaggaattgttggagtcatcggaccagatattgaggagtatgaaaggtttatcgagcactagcatagtctacatcctgattgcagtgtgtcttggagggttgatagggatccccgctttaatatgttgctgcagggggcgttgtaacaaaaagggagaacaagttggtatgtcaagaccaggcctaaagcctgatcttacgggaacatcaaaatcctatgtaaggtcgctctgatcctctacaactcttgaaacacaaatgtcccacaagtctcctcttcgtcatcaagcaaccaccgcacccagcatcaagcccacctgaaattatctccggcttccctctggccgaacaatatcggtagttaatcaaaacttagggtgcaagatcatccacaatgtcaccacaacgagaccggataaatgccttctacaaagataacccccatcccaagggaagtaggatagtcattaacagagaacatcttatgattgatagaccttatgttttgctggctgttctgtttgtcatgtttctgagcttgatcgggttgctagccattgcaggcattagacttcatcgggcagccatctacaccgcagagatccataaaagcctcagcaccaatctagatgtaactaactcaatcgagcatcaggtcaaggacgtgctgacaccactcttcaaaatcatcggtgatgaagtgggcctgaggacacctcagagattcactgacctagtgaaattaatctctgacaagattaaattccttaatccggatagggagtacgacttcagagatctcacttggtgtatcaacccgccagagagaatcaaattggattatgatcaatactgtgcagatgtggctgctgaagagctcatgaatgcattggtgaactcaactctactggagaccagaacaaccaatcagttcctagctgtctcaaagggaaactgctcagggcccactacaatcagaggtcaattctcaaacatgtcgctgtccctgttagacttgtatttaggtcgaggttacaatgtgtcatctatagtcactatgacatcccagggaatgtatgggggaacttacctagtggaaaagcctaatctgagcagcaaaaggtcagagttgtcacaactgagcatgtaccgagtgtttgaagtaggtgttatcagaaatccgggtttgggggctccggtgttccatatgacaaactatcttgagcaaccagtcagtaatgatctcagcaactgtatggtggctttgggggagctcaaactcgcagccctttgtcacggggaagattctatcacaattccctatcagggatcagggaaaggtgtcagcttccagctcgtcaagctaggtgtctggaaatccccaaccgacatgcaatcctgggtccccttatcaacggatgatccagtgatagacaggctttacctctcatctcacagaggtgttatcgctgacaatcaagcaaaatgggctgtcccgacaacacgaacagatgacaagttgcgaatggagacatgcttccaacaggcgtgtaagggtaaaatccaagcactctgcgagaatcccgagtgggcaccattgaaggataacaggattccttcatacggggtcttgtctgttgatctgagtctgacagttgagcttaaaatcaaaattgcttcgggattcgggccattgatcacacacggttcagggatggacctatacaaatccaaccacaacaatgtgtattggctgactatcccgccaatgaagaacctagccttaggtgtaatcaacacattggagtggataccgagattcaaggttagtccctacctcttcactgtcccaattaaggaagcaggcgaagactgccatgccccaacatacctacctgcggaggtggatggtgatgtcaaactcagttccaatctggtgattctacctggtcaagatctccaatatgttttggcaacctacgatacttccagggttgaacatgctgtggtttattacgtttacagcccaagccgctcattttcttacttttatccttttaggttgcctataaagggggtccccatcgaattacaagtggaatgcttcacatgggaccaaaaactctggtgccgtcacttctgtgtgcttgcggactcagaatctggtggacatatcactcactctgggatggtgggcatgggagtcagctgcacagtcacccgggaagatggaaccaatcgcagatagggctgctagtgaaccaatcacatgatgtcacccagacatcaggcatacccactagtgtgaaatagacatcagaattaagaaaaacgtagggtccaagtggttccccgttatggactcgctatctgtcaaccagatcttataccctgaagttcacctagatagcccgatagttaccaataagatagtagccatcctggagtatgctcgagtccctcacgcttacagcctggaggaccctacactgtgtcagaacatcaagcaccgcctaaaaaacggattttccaaccaaatgattataaacaatgtggaagttgggaatgtcatcaagtccaagcttaggagttatccggcccactctcatattccatatccaaattgtaatcaggatttatttaacatagaagacaaagagtcaacgaggaagatccgtgaactcctcaaaaaggggaattcgctgtactccaaagtcagtgataaggttttccaatgcttaagggacactaactcacggcttggcctaggctccgaattgagggaggacatcaaggagaaagttattaacttgggagtttacatgcacagctcccagtggtttgagccctttctgttttggtttacagtcaagactgagatgaggtcagtgattaaatcacaaacccatacttgccataggaggagacacacacctgtattcttcactggtagttcagttgagttgctaatctctcgtgaccttgttgctataatcagtaaagagtctcaacatgtatattacctgacatttgaactggttttgatgtattgtgatgtcatagaggggaggttaatgacagagaccgctatgactattgatgctaggtatacagagcttctaggaagagtcagatacatgtggaaactgatagatggtttcttccctgcactcgggaatccaacttatcaaattgtagccatgctggagcctctttcacttgcttacctgcagctgagggatataacagtagaactcagaggtgctttccttaaccactgctttactgaaatacatgatgttcttgaccaaaacgggttttctgatgaaggtacttatcatgagttaactgaagctctagattacattttcataactgatgacatacatctgacaggggagattttctcatttttcagaagtttcggccaccccagacttgaagcagtaacggctgctgaaaatgttaggaaatacatgaatcagcctaaagtcattgtgtatgagactctgatgaaaggtcatgccatattttgtggaatcataatcaacggctatcgtgacaggcacggaggcagttggccaccgctgaccctccccctgcatgctgcagacacaatccggaatgctcaagcttcaggtgaagggttaacacatgagcagtgcgttgataactggaaatcttttgctggagtgaaatttggctgctttatgcctcttagcctggatagtgatctgacaatgtacctaaaggacaaggcacttgctgctctccaaagggaatgggattcagtttacccgaaagagttcctgcgttacgaccctcccaagggaaccgggtcacggaggcttgtagatgttttccttaatgattcgagctttgacccatatgatgtgataatgtatgttgtaagtggagcttacctccatgaccctgagttcaacctgtcttacagcctgaaagaaaaggagatcaaggaaacaggtagactttttgctaaaatgacttacaaaatgagggcatgccaagtgattgctgaaaatctaatctcaaacgggattggcaaatattttaaggacaatgggatggccaaggatgagcacgatttgactaaggcactccacactctagctgtctcaggagtccccaaagatctcaaagaaagtcacaggggggggccagtcttaaaaacctactcccgaagcccagtccacacaagtaccaggaacgtgagagcagcaaaagggtttatagggttccctcaagtaattcggcaggaccaagacactgatcatccggagaatatggaagcttacgagacagtcagtgcatttatcacgactgatctcaagaagtactgccttaattggagatatgagaccatcagcttgtttgcacagaggctaaatgagatttacggattgccctcatttttccagtggctgcataagaggcttgagacctctgtcctgtatgtaagtgaccctcattgcccccccgaccttgacgcccatatcccgttatataaagtccccaatgatcaaatcttcattaagtaccctatgggaggtatagaagggtattgtcagaagctgtggaccatcagcaccattccctatctatacctggctgcttatgagagcggagtaaggattgcttcgttagtgcaaggggacaatcagaccatagccgtaacaaaaagggtacccagcacatggccctacaaccttaagaaacgggaagctgctagagtaactagagattactttgtaattcttaggcaaaggctacatgatattggccatcacctcaaggcaaatgagacaattgtttcatcacatttttttgtctattcaaaaggaatatattatgatgggctacttgtgtcccaatcactcaagagcatcgcaagatgtgtattctggtcagagactatagttgatgaaacaagggcagcatgcagtaatattgctacaacaatggctaaaagcatcgagagaggttatgaccgttaccttgcatattccctgaacgtcctaaaagtgatacagcaaattctgatctctcttggcttcacaatcaattcaaccatgacccgggatgtagtcatacccctcctcacaaacaacgacctcttaataaggatggcactgttgcccgctcctattggggggatgaattatctgaatatgagcaggctgtttgtcagaaacatcggtgatccagtaacatcatcaattgctgatctcaagagaatgattctcgcctcactaatgcctgaagagaccctccatcaagtaatgacacaacaaccgggggactcttcattcctagactgggctagcgacccttactcagcaaatcttgtatgtgtccagagcatcactagactcctcaagaacataactgcaaggtttgtcctgatccatagtccaaacccaatgttaaaaggattattccatgatgacagtaaagaagaggacgagggactggcggcattcctcatggacaggcatattatagtacctagggcagctcatgaaatcctggatcatagtgtcacaggggcaagagagtctattgcaggcatgctggataccacaaaaggcttgattcgagccagcatgaggaagggggggttaacctctcgagtgataaccagattgtccaattatgactatgaacaattcagagcagggatggtgctattgacaggaagaaagagaaatgtcctcattgacaaagagtcatgttcagtgcagctggcgagagctctaagaagccatatgtgggcgaggctagctcgaggacggcctatttacggccttgaggtccctgatgtactagaatctatgcgaggccaccttattcggcgtcatgagacatgtgtcatctgcgagtgtggatcagtcaactacggatggttttttgtcccctcgggttgccaactggatgatattgacaaggaaacatcatccttgagagtcccatatattggttctaccactgatgagagaacagacatgaagcttgccttcgtaagagccccaagtcgatccttgcgatctgctgttagaatagcaacagtgtactcatgggcttacggtgatgatgatagctcttggaacgaagcctggttgttggctaggcaaagggccaatgtgagcctggaggagctaagggtgatcactcccatctcaacttcgactaatttagcgcataggttgagggatcgtagcactcaagtgaaatactcaggtacatcccttgtccgagtggcgaggtataccacaatctccaacgacaatctctcatttgtcatatcagataagaaggttgatactaactttatataccaacaaggaatgcttctagggttgggtgttttagaaacattgtttcgactcgagaaagataccggatcatctaacacggtattacatcttcacgtcgaaacagattgttgcgtgatcccgatgatagatcatcccaggatacccagctcccgcaagctagagctgagggcagagctatgtaccaacccattgatatatgataatgcacctttaattgacagagatgcaacaaggctatacacccagagccataggaggcaccttgtggaatttgttacatggtccacaccccaactatatcacattttagctaagtccacagcactatctatgattgacctggtaacaaaatttgagaaggaccatatgaatgaaatttcagctctcataggggatgacgatatcaatagtttcataactgagtttctgctcatagagccaagattattcactatctacttgggccagtgtgcggccatcaattgggcatttgatgtacattatcatagaccatcagggaaatatcagatgggtgagctgttgtcatcgttcctttctagaatgagcaaaggagtgtttaaggtgcttgtcaatgctctaagccacccaaagatctacaagaaattctggcattgtggtattatagagcctatccatggtccttcacttgatgctcaaaacttgcacacaactgtgtgcaacatggtttacacatgctatatgacctacctcgacctgttgttgaatgaagagttagaagagttcacatttctcttgtgtgaaagcgacgaggatgtagtaccggacagattcgacaacatccaggcaaaacacttatgtgttctggcagatttgtactgtcaaccagggacctgcccaccaattcgaggtctaagaccggtagagaaatgtgcagttctaaccgaccatatcaaggcagaggctatgttatctccagcaggatcttcgtggaacataaatccaattattgtagaccattactcatgctctctgacttatctccggcgaggatcgatcaaacagataagattgagagttgatccaggattcattttcgacgccctcgctgaggtaaatgtcagtcagccaaagatcggcagcaacaacatctcaaatatgagcatcaaggctttcagacccccacacgatgatgttgcaaaattgctcaaagatatcaacacaagcaagcacaatcttcccatttcagggggcaatctcgccaattatgaaatccatgctttccgcagaatcgggttgaactcatctgcttgctacaaagctgttgagatatcaacattaattaggagatgccttgagccaggggaggacggcttgttcttgggtgagggatcgggttctatgttgatcacttataaagagatacttaaactaaacaagtgcttctataatagtggggtttccgccaattctagatctggtcaaagggaattagcaccctatccctccgaagttggccttgtcgaacacagaatgggagtaggtaatattgtcaaagtgctctttaacgggaggcccgaagtcacgtgggtaggcagtgtagattgcttcaatttcatagttagtaatatccctacctctagtgtggggtttatccattcagatatagagaccttgcctgacaaagatactatagagaagctagaggaattggcagccatcttatcgatggctctgctcctgggcaaaataggatcaatactggtgattaagcttatgcctttcagcggggattttgttcagggatttataagttatgtagggtctcattatagagaagtgaaccttgtataccctagatacagcaacttcatctctactgaatcttatttggttatgacagatctcaaggctaaccggctaatgaatcctgaaaagattaagcagcagataattgaatcatctgtgaggacttcacctggacttataggtcacatcctatccattaagcaactaagctgcatacaagcaattgtgggagacgcagttagtagaggtgatatcaatcctactctgaaaaaacttacacctatagagcaggtgctgatcaattgcgggttggcaattaacggacctaagctgtgcaaagaattgatccaccatgatgttgcctcagggcaagatggattgcttaattctatactcatcctctacagggagttggcaagattcaaagacaaccaaagaagtcaacaagggatgttccacgcttaccccgtattggtaagtagcaggcaacgagaacttatatctaggatcacccgcaaattctgggggcacattcttctttactccgggaacaaaaagttgataaataagtttatccagaatctcaagtccggctatctgatactagacttacaccagaatatcttcgttaagaatctatccaagtcagagaaacagattattatgacggggggtttgaaacgtgagtgggtttttaaggtaacagtcaaggagaccaaagaatggtataagttagtcggatacagtgccctgattaaggactaattggttgaactccggaaccctaatcctgccctaggtggttaggcattatttgcaatatattaaagaaaactttgaaaatacgaagtttctattcccagctttgtctggtggccggcatggtcccagcctcctcgctggcgccggctgggcaacattccgaggggaccgtcccctcggtaatggcgaatgggacgcggccgatccggctgctaacaaagcccgaaaggaagctgagttggctgctgccaccgctgagcaataactagcataaccccttggggcctctaaacgggtcttgaggggttttttgctgaaaggaggaactatatccggatgcggccgcgggccctatggtacccagcttttgttccctttagtgagggttaattccgagcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctcggcccccctgacgagcatcacaaaaatcgacgctcaagtcagaggtggcgaaacccgacaggactataaagataccaggcgttcccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactgcccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgaaaaaaagcggttagctccttcggtcctccgatcgttgtcagaagtaagttggccgcagtgttatcactcatgcttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagccaccgcggtgatccttataaagctagatg

SEQ ID NO: 61 - protein, 591 aa, Artificial sequence
  Protein encoded by SEQ ID NO: 53
RRGADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRS

SEQ ID NO: 62 - protein, 692 aa, Artificial sequence
  Protein encoded by SEQ ID NOs: 54
RRGADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGDFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 63 - DNA, 1209 bp, Artificial sequence
  sE antigen no codon optimization
atcaggtgcataggagtcagcaatagggactttgtggaaggtatgtcaggtgggacctgggttgatgttgtcttggaacatggaggttgtgtcaccgtaatggcacaggacaaaccgactgtcgacatagagctggttacaacaacagtcagcaacatggcggaggtaagatcctactgctatgaggcatcaatatcagacatggcttcggacagccgctgcccaacacaaggtgaagcctaccttgacaagcaatcagacactcaatatgtctgcaaaagaacgttagtggacagaggctggggaaatggatgtggactttttggcaaagggagcctggtgacatgcgctaagtttgcatgctccaagaaaatgaccgggaagagcatccagccagagaatctggagtaccggataatgctgtcagttcatggctcccagcacagtgggatgattgttaatgacacaggacatgaaactgatgagaatagagcgaaagttgagataacgcccaattcaccaagagccgaagccaccctggggggttttggaagcctaggacttgattgtgaaccgaggacaggccttgacttttcagatttgtattacttgactatgaataacaagcactggttggttcacaaggagtggttccacgacattccattaccttggcacgctggggcagacaccggaactccacactggaacaacaaagaagcactggtagagttcaaggacgcacatgccaaaaggcaaactgtcgtggttctagggagtcaagaaggagcagttcacacggcccttgctggagctctggaggctgagatggatggtgcaaagggaaggctgtcctctggccacttgaaatgtcgcctgaaaatggataaacttagattgaagggcgtgtcatactccttgtgtactgcagcgttcacattcaccaagatcccggctgaaacactgcacgggacagtcacagtggaggtacagtacgcagggacagatggaccttgcaaggttccagctcagatggcggtggacatgcaaactctgaccccagttgggaggttgataaccgctaaccccgtaatcactgaaagcactgagaactctaagatgatgctggaacttgatccaccatttggggactcttacattgtcataggagtcggggagaagaagatcacccaccactggcacaggagt

SEQ ID NO: 64 - DNA, 1209 bp, Artificial sequence
  sE antigen codon optimization (human)
atcagatgcatcggagtttccaatcgtgactttgtcgaagggatgtccggaggcacctgggttgacgtggtgcttgagcatggtggctgcgtaacggtaatggctcaggacaaacccacggttgacatagaactggtgaccacgactgtcagtaatatggccgaagtgcgaagctactgctatgaggcctctatctctgacatggcatcagacagccggtgtccaactcaaggcgaagcttatctggacaagcaatccgatacacagtacgtgtgcaagcggactctcgtggatagaggttggggcaatgggtgtggtctgtttgggaaaggcagtctggtaacatgcgcaaagttcgcatgttccaagaaaatgacaggaaagagcattcagccggaaaatctggagtataggattatgctcagcgtgcatgggagccagcacagtggcatgattgtcaatgatacaggccacgaaaccgacgagaacagagcgaaggttgagatcactcccaattcacctcgcgcagaggccactctgggagggtttggaagtctcggtctggactgtgaacctcgcactggcctggacttcagcgatctgtattacctgacgatgaacaacaagcattggctggtccataaggagtggttccatgatattccgcttccttggcatgccggagccgataccggaacaccccactggaacaacaaagaggctttggtggagttcaaagatgcacacgctaagcgccaaaccgtcgtggtcctgggtagccaagaaggagcggttcacactgcgcttgccggagccctggaggcggaaatggatggggccaaagggcgcctttccagtggacacctgaagtgtcggctgaaaatggacaagctgagactgaaaggtgtgtcttacagcctgtgcaccgcagccttcactttcaccaaaatccctgctgaaaccttgcacggaacagtgacagtagaggtgcagtatgcaggcacagatggcccatgtaaggtgccagctcagatggcagtggacatgcagaccctgactccagtgggaaggctcataactgccaatccggtcatcacagagtctaccgagaactcaaagatgatgctggagctggaccctccctttggggactcttacatagtcataggggtaggcgagaagaaaatcacccatcactggcacaggagc

SEQ ID NO: 65 - protein, 403 aa, Artificial sequence
  sE antigen L107D
IRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGDFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRS

SEQ ID NO: 66 - protein, 504 aa, Artificial sequence
  E antigen L107D
IRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGDFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 67 - DNA, 10272 bp, Zika virus
  Isolate GD01 polyprotein gene, complete cds
atgaaaaacccaaaaaagaaatccggaggattccggattgtcaatatgctaaaacgcggagtagcccgtgtgagcccctttgggggcttgaagaggctgccagccggacttctgctgggtcatgggcccatcaggatggtcttggcgattctagcctttttgagattcacggcaatcaagccatcactgggtctcatcaatagatggggttcagtggggaaaaaagaggctatggaaataataaagaagttcaagaaagatctggctgccatgctgagaataatcaatgctaggaaggagaagaagagacgaggcgcagaaactagtgtcggaattgttggcctcctgctgaccacagctatggcagcggaggtcactagacgtgggagtgcatactatatgtacttggacagaaacgatgctggggaggccatatcttttccaaccacattggggatgaataagtgttatatacagatcatggatcttggacacatgtgtgatgccaccatgagctatgaatgccctatgctggatgagggggtggaaccagatgacgtcgattgttggtgcaacacgacgtcaacttgggttgtgtacggaacctgccatcacaaaaaaggtgaagcacggagatctagaagagctgtgacgctcccttcccattccactaggaagctgcaaacgcggtcgcaaacctggttggaatcaagagaatacacaaagcacttgattagagtcgaaaattggatattcaggaaccctggcttcgcgttagcagcagctgctatcgcttggcttttgggaagctcaacgagccaaaaagtcatatacttggtcatgatactgctgattgccccggcatacagcatcaggtgcataggagtcagcaatagggactttgtggaaggtatgtcaggtgggacttgggttgatgttgtcttggaacatggaggttgtgtcaccgtaatggcacaggacaaaccgactgtcgacatagagctggttacaacaacagtcagcaacatggcggaggtaagatcctactgctatgaggcatcaatatcagacatggcttcggacagccgctgcccaacacaaggtgaagcctaccttgacaagcaatcagacactcaatatgtctgcaaaagaacgttagtggacagaggctggggaaatggatgtggactttttggcaaagggagcctggtgacatgcgctaagtttgcatgctccaagaaaatgaccgggaaaagcatccagccagagaatctggagtaccggataatgctgtcagttcatggctcccagcacagtgggatgattgttaatggcacaggacatgaaactgatgagaatagagcgaaagttgagataacgcccaattcaccaagagccgaagccaccctggggggttttggaagcctaggacttgattgtgaaccgaggacaggccttgacttttcagatttgtattacttgactatgaataacaagcactggttggttcacaaggagtggttccacgacattccattaccttggcacgctggggcagacaccggaactccacactggaacaacaaagaagcactggtagagttcaaggacgcacatgccaaaaggcaaactgtcgtggttctagggagtcaagaaggagcagttcacacggcccttgctggagctctggaggctgagatggatggagcaaagggaaggctgtcctctggccacttgaaatgtcgcctgaaaatggataaacttagattgaagggcgtgtcatactccttgtgtactgcagcgttcacattcaccaagatcccggctgaaacactgcacgggacagtcacagtggaggtacagtacgcagggacagatggaccttgcaaggttccagctcagatggcggtggacatgcaaactctgaccccagttgggaggttgataaccgctaaccccgtaatcactgaaagcactgagaactctaagatgatgctggaacttgatccaccatttggggactcttacattgtcataggagtcggggagaagaagatcacccaccactggcacaggagtggcagcaccattggaaaagcatttgaagccactgtgagaggtgccaagagaatggcagtcttgggagacacagcctgggactttggatcagttggaggcgctctcaactcattgggcaagggcatccatcaaatttttggagcagctttcaaatcattgtttggaggaatgtcctggttctcacaaattctcattggaacgttgctgatgtggttgggtctgaacacaaagaatggatctatttcccttatgtgcttggccttagggggagtgttgatcttcttatccacagccgtctctgctgatgtggggtgctcggtggacttctcaaagaaggagacgagatgcggtacaggggtgtttgtctataacgacgttgaagcctggagggacaggtacaagtaccatcctgactccccccgtagattggcagcagcagtcaagcaagcctgggaagatggtatctgcgggatctcctctgtttcaagaatggaaaacatcatgtggagatcagtagaaggggagctcaacgcaatcctggaagagaatggagttcaactgacggtcgttgtgggatctgtaaaaaaccccatgtggagaggtccacagagattgcccgtgcctgtgaacgagctgccccacggctggaaggcttgggggaaatcgtacttcgtcagagcagcaaagacaaataacagctttgtcgtggatggtgacacactgaaggaatgcccactcaaacatagagcatggaacagctttcttgtggaggatcatgggttcggggtatttcacactagtgtctggctcaaggttagagaagactattcattagagtgtgatccagccgttattggaacagctgttaagggaaaggaggctgtacacagtgatctaggctactggattgagagtgagaagaatgacacatggaggctgaagagggcccatctgatcgagatgaaaacatgtgaatggccaaagtcccacacattgtggacagatggaatagaagagagtgatctgatcatacccaagtctttagctgggccactcagccatcacaataccagagagggctacaggacccaaatgaaagggccatggcacagtgaggagcttgaaattcggtttgaggaatgcccaggcactaaggtccacgtggaggaaacatgtggaacaagaggaccatctctgagatcaaccactgcaagcggaagggtgatcgaggaatggtgctgcagggagtgcacaatgcccccactgtcgttccgggctaaagatggctgttggtatggaatggagataaggcccaggaaagaaccagaaagcaacttagtaaggtcaatggtgactgcaggatcaactgatcacatggaccacttctcccttggagtgcttgtgatcctgctcatggtgcaggaagggctgaagaagagaatgaccacaaagatcatcataagcacatcaatggcagtgctggtagctatgatcctgggaggattttcaatgagtgacctggctaagcttgcaattttgatgggtgccaccttcgcggaaatgaacactggaggagatgtagctcatctggcgctgatagcggcattcaaagtcagaccagcgttgctggtatctttcatcttcagagctaattggacaccccgtgaaagcatgctgctggccttggcctcgtgtcttttgcaaactgcgatctccgccttggaaggcgacctgatggttctcatcaatggttttgctttggcctggttggcagtacgagcgatggttgttccacgcactgataacatcaccttagcaatcctggctgctctgacaccactggcccggggcacactgcttgtggcgtggagagcaggccttgctacttgcggggggtttatgctcctctctctgaagggaaaaggcagtgtgaagaagaacttaccatttgtcatggccctgggactaaccgctgtgaggctggtcgaccccatcaacgtggtgggactgctgttgctcacaaggagtgggaagcggagctggccccctagcgaagtactcacagctgttggcctgatatgcgcattggctggagggttcgccaaggcagatatagagatggctgggcccatggccgcggtcggtctgctaattgtcagttacgtggtctcaggaaagagtgtggacatgtacattgaaagagcaggtgacatcacatgggaaaaagatgcggaagtcactggaaacagtccccggctcgatgtggcgctagatgagagtggtgatttctccctggtggaggatgacggtccccccatgagagagatcatactcaaggtggtcctgatgaccatctgtggcatgaacccaatagccataccctttgcagctggagcgtggtacgtatacgtgaagactggaaaaaggagtggtgctctatgggatgtgcctgctcccaaggaagtaaaaaagggggagaccacagatggagtgtacagagtaatgactcgcagactgctaggttcaacacaagttggagtgggagttatgcaagagggggtctttcacactatgtggcacgtcacaaaaggatccgcgctgagaagcggtgaagggagacttgatccatactggggagatgtcaagcaggatctggtgtcatactgtggtccatggaagctagatgccgcctgggacgggcacagcgaggtgcagctcttggccgtgccccccggagagagagcgaggaacatccagactctgcccggaatatttaagacaaaggatggggacattggagcggttgcgctggattacccagcaggaacttcaggatctccaatcctagacaagtgtgggagagtgataggactttatggcaatggggtcgtgatcaaaaatgggagttatgttagtgccatcacccaagggaggagggaggaagagactcctgttgagtgcttcgagccttcgatgctgaagaagaagcagctaactgtcttagacttgcatcctggagctgggaaaaccaggagagttcttcctgaaatagtccgtgaagccataaaaacaagactccgtactgtgatcttagctccaaccagggttgtcgctgctgaaatggaggaggcccttagagggcttccagtgcgttatatgacaacagcagtcaatgtcacccactctggaacagaaatcgtcgacttaatgtgccatgccaccttcacttcacgtctactacagccaattagagtccccaactataatctgtatattatggatgaggcccacttcacagatccctcaagtatagcagcaagaggatacatttcaacaagggttgagatgggcgaggcggctgccatcttcatgaccgccacgccaccaggaacccgtgacgcatttccggactccaactcaccaattatggacaccgaagtggaagtcccagagagagcctggagctcaggctttgattgggtgacggatcattctggaaaaacagtttggtttgttccaagcgtgaggaacggcaatgagatcgcagcttgtctgacaaaggctggaaaacgggtcatacagctcagcagaaagacttttgagacagagttccagaaaacaaaacatcaagagtgggactttgtcgtgacaactgacatttcagagatgggcgccaactttaaagctgaccgtgtcatagattccaggagatgcctaaagccggtcatacttgatggcgagagagtcattctggctggacccatgcctgtcacacatgccagcgctgcccagaggagggggcgcataggcaggaatcccaacaaacctggagatgagtatctgtatggaggtgggtgcgcagagactgacgaagaccatgcacactggcttgaagcaagaatgctccttgacaatatttacctccaagatggcctcatagcctcgctctatcgacctgaggccgacaaagtagcagccattgagggagagttcaagcttaggacggagcaaaggaagacctttgtggaactcatgaaaagaggagatcttcctgtttggctggcctatcaggttgcatctgccggaataacctacacagatagaagatggtgctttgatggcacgaccaacaacaccataatggaagacagtgtgccggcagaggtgtggaccagacacggagagaaaagagtgctcaaaccgaggtggatggacgccagagtttgttcagatcatgcggccctgaagtcattcaaggagtttgccgctgggaaaagaggagcggcttttggagtgatggaagccctgggaacactgccaggacacatgacagagagattccaggaagccattgacaacctcgctgtgctcatgcgggcagagactggaagcaggccttacaaagccgcggcagcccaattgccggagaccctagagaccattatgcttttggggttgctgggaacagtctcgctgggaatcttcttcgtcttgatgaggaacaagggcatagggaagatgggctttggaatggtgactcttggggccagcgcatggctcatgtggctctcggaaattgagccagccagaattgcatgtgtcctcattgttgtgttcctattgctggtggtgctcatacctgagccagaaaagcaaagatctccccaggacaaccaaatggcaatcatcatcatggtagcagtaggtcttctgggcttgattaccgccaatgaactcggatggttggagagaacaaagagtgacctaagccatctaatgggaaggagagaggagggggcaaccataggattctcaatggacattgacctgcggccagcctcagcttgggccatctatgctgccttgacaactttcattaccccagccgtccaacatgcagtgaccacctcatacaacaactactccttaatggcgatggccacgcaagctggagtgttgtttggtatgggcaaagggatgccattctacgcatgggactttggagtcccgctgctaatgataggctgctactcacaattaacacccctgaccctaatagtggccatcattttgctcgtggcgcactacatgtacttgatcccagggctgcaggcagcagctgcgcgtgctgcccagaagagaacggcagctggcatcatgaagaaccctgttgtggatggaatagtggtgactgacattgacacaatgacaattgacccccaagtggagaaaaagatgggacaggtgctactcatagcagtagccgtctccagcgccatactgtcgcggaccgcctgggggtggggggaggctggggccctgatcacagccgcaacttccactttgtgggaaggctctccgaacaagtactggaactcctctacagccacttcactgtgtaacatttttaggggaagttacttggctggagcttctctaatctacacagtaacaagaaacgctggcttggtcaagagacgtgggggtggaacaggagagaccctgggagagaaatggaaggcccgcttgaaccagatgtcggccctggagttctactcctacaaaaagtcaggcatcaccgaggtgtgcagagaagaggcccgccgcgccctcaaggacggtgtggcaacgggaggccatgctgtgtcccgaggaagtgcaaagctgagatggttggtggagcggggatacctgcagccctatggaaaggtcattgatcttggatgtggcagagggggctggagttactacgccgccaccatccgcaaagttcaagaagtgaaaggatacacaaaaggaggccctggtcatgaagaacccgtgttggtgcaaagctatgggtggaacatagtccgtcttaagagtggggtggacgtctttcatatggcggctgagccgtgtgacacgttgctgtgtgacataggtgagtcatcatctagtcctgaagtggaagaagcacggacgctcagagtcctctccatggtgggggattggcttgaaaaaagaccaggagccttttgtataaaggtgttgtgcccatacaccagcactatgatggaaaccctggagcgactgcagcgtaggtatgggggaggactggtcagagtgccactctcccgcaactctacacatgagatgtactgggtctctggagcgaaaagcaacatcataaaaagtgtgtccaccacgagccagctcctcttggggcgcatggacgggcctaggaggccagtgaaatatgaggaggatgtgaatctcggctctggcacgcgggctgtggcaagctgcgctgaagctcccaacatgaagatcattggtaaccgcattgaaaggatccgcagtgagcacgcggaaacgtggttctttgacgagaaccacccatataggacatgggcttaccatggaagctatgaggcccccacacaagggtcagcgtcctctctaataaacggggttgtcaggctcctgtcaaaaccctgggatgtggtgactggagtcacaggaatagccatgaccgacaccacaccgtatggtcagcaaagagttttcaaggaaaaagtggacactagggtgccagacccccaagaaggcactcgtcaggttatgagcatggtctcttcctggttgtggaaagagctaggcaaacacaaacggccacgagtctgtaccaaagaagagttcatcaacaaggttcgtagcaatgcagcattaggggcaatatttgaagaggaaaaagagtggaagactgcagtggaagctgtgaacgatccaaggttctgggctctagtggacaaggaaagagagcaccacctgagaggagagtgccagagttgtgtgtacaacatgatgggaaaaagagaaaagaaacaaggggaatttggaaaggccaagggcagccgcgccatctggtatatgtggctaggggctagatttctagagttcgaagcccttggattcttgaacgaggatcactggatggggagagagaactcaggaggtggtgttgaagggctgggattacaaagactcggatatgtcctagaagagatgagtcgtataccaggaggaaggatgtatgcagatgacactgctggctgggacacccgcattagcaggtttgatctggagaatgaagctctaatcaccaaccaaatggagaaagggcacagggccttggcattggccataatcaagtacacataccaaaacaaagtggtaaaggtccttagaccagctgaaaaagggaaaacagttatggacattatttcgagacaagaccaaagggggagcggacaagttgtcacttacgctcttaacacatttaccaacctagtggtgcaactcattcggaatatggaggctgaggaagttctagagatgcaagacttgtggctgctgcggaggtcagagaaagtgaccaactggttgcagagcaacggatgggataggctcaaacgaatggcagtcagtggagatgattgcgttgtgaagccaattgatgataggtttgcacatgccctcaggttcttgaatgatatgggaaaagttaggaaggacacacaagagtggaaaccctcaactggatgggacaactgggaagaagttccgttttgctcccaccatttcaacaagctccatctcaaggacgggaggtccattgtggttccctgccgccaccaagatgaactgattggccgggcccgcgtctctccaggggcgggatggagcatccgggagactgcttgcctagcaaaatcatatgcgcaaatgtggcagctcctttatttccacagaagggacctccgactgatggccaatgccatttgttcatctgtgccagttgactgggttccaactgggagaactacctggtcaatccatggaaagggagaatggatgaccactgaagacatgcttgtggtgtggaacagagtgtggattgaggagaacgaccacatggaagacaagaccccagttacgaaatggacagacattccctatttgggaaaaagggaagacttgtggtgtggatctctcatagggcacagaccgcgcaccacctgggctgagaacattaaaaacacagtcaacatggtgcgcaggatcataggtgatgaagaaaagtacatggactacctatccacccaagttcgctacttgggtgaagaagggtctacacctggagtgctgtaa

SEQ ID NO: 68 - DNA, 10617 bp, Zika virus
  Strain MRS_OPY_Martinique_PaRi_2015 polyprotein gene, complete cds
agtatcaacaggttttattttggatttggaaacgagagtttctggtcatgaaaaacccaaaaaagaaatccggaggattccggattgtcaatatgctaaaacgcggagtagcccgtgtgagcccctttgggggcttgaagaggctgccagccggacttctgctgggtcatgggcccatcaggatggtcttggcgattctagcctttttgagattcacggcaatcaagccatcactgggtctcatcaatagatggggttcagtggggaaaaaagaggctatggaaataataaagaagttcaagaaagatctggctgccatgctgagaataatcaatgctaggaaggagaagaagagacgaggcgcagaaactagtgtcggaattgttggcctcctgctgaccacagctatggcagcggaggtcactagacgtgggagtgcatactatatgtacttggacagaaacgatgctggggaggccatatcttttccaaccacattggggatgaataagtgttatatacagatcatggatcttggacacatgtgtgatgccaccatgagctatgaatgccctatgctggatgagggggtggaaccagatgacgtcgattgttggtgcaacacgacgtcaacttgggttgtgtacggaacctgccatcacaaaaaaggtgaagcacggagatctagaagagccgtgacgctcccctcccattccactaggaagctgcaaacgcggtcgcaaacctggttggaatcaagagaatacacaaagcacttgattagagtcgaaaattggatattcaggaaccctggtttcgctttagcagcagctgccatcgcgtggcttttgggaagctcaacgagccaaaaagtcatatacttggtcatgatactgctgattgccccggcatacagcatcaggtgcataggagtcagcaatagggactttgtggaaggtatgtcaggtgggacttgggttgatgttgtcttggaacatggaggttgtgtcaccgtaatggcacaggacaaaccgactgtcgacatagagctggttacaacaacagtcagcaacatggcggaggtaagatcctactgctatgaggcatcaatatcagacatggcttcggacagccgctgcccaacacaaggtgaagcctaccttgacaagcaatcagacactcaatatgtctgcaaaagaacgttagtggacagaggctggggaaatggatgtggactttttggcaaagggagcctggtgacatgcgctaagtttgcatgctccaagaaaatgaccgggaagagcatccagccagagaatctggagtaccggataatgttgtcagttcatggctcccagcacagtgggatgatcgttaatgacacaggacatgaaactgatgagaatagagcgaaggttgagataacgcccaattcaccaagagccgaagccaccctggggggttttggaagcctaggacttgattgtgaaccgaggacaggccttgacttttcagatttgtattacttgactatgaataacaagcactggttggttcacaaggagtggttccacgacattccattaccttggcacgctggggcagacaccggaactccacactggaacaacaaagaagcactggtagagttcaaggacgcacatgccaaaaggcaaactgtcgtggttctagggagtcaagaaggagcagttcacacggcccttgctggagctctggaggctgagatggatggtgcaaagggaaggctgtcctctggccacttgaaatgtcgcctgaaaatggataaacttagattgaagggcgtgtcatactccttgtgtaccgcagcgttcacattcaccaagatcccggctgaaacactgcacgggacagtcacagtggaggtacagtacgcagggacagatggaccttgcaaggttccagcccagatggcggtggacatgcaaactctgaccccagttgggaggttgataaccgctaaccccgtaatcactgaaagcactgagaactctaagatgatgctggaacttgatccaccatttggggactcttacattgtcataggagtcggggagaagaagatcacccaccactggcacaggagtggcagcaccattggaaaagcatttgaagccactgtgagaggtgccaagagaatggcagtcttgggagacacagcctgggactttggatcagttggaggcgctctcaactcattgggcaagggcatccatcaaatttttggagcagctttcaaatcattgtttggaggaatgtcctggttctcacaaattctcattggaacgttgctgatgtggttgggtctgaacacaaagaatggatctatttcccttatgtgcttggccttagggggagtgttgatcttcttatccacagccgtctctgctgatgtggggtgctcggtggacttctcaaagaaggagacgagatgtggtacaggggtgttcgtctataacgacgttgaagcctggagggacaggtacaagtaccatcctgactccccccgtagattggcagcagcagtcaagcaagcctgggaagatggtatctgcgggatctcctctgtttcaagaatggaaaacatcatgtggagatcagtagaaggggagctcaacgcaatcctggaagagaatggagttcaactgacggtcgttgtgggatctgtaaaaaaccccatgtggagaggtccacagagattgcccgtgcctgtgaacgagctgccccacggctggaaggcttgggggaaatcgtacttcgtcagagcagcaaagacaaataacagctttgtcgtggatggtgacacactgaaggaatgcccactcaaacatagagcatggaacagctttcttgtggaggatcatgggttcggggtatttcacactagtgtctggctcaaggttagagaagattattcattagagtgtgatccagccgttattggaacagctgttaagggaaaggaggctgtacacagtgatctaggctactggattgagagtgagaagaatgacacatggaggctgaagagggcccatctgatcgagatgaaaacatgtgaatggccaaaatcccacacattgtggacagatggaatagaagagagtgatctgatcatacccaagtctttagctgggccactcagccatcacaataccagagagggctacaggacccaaatgaaagggccatggcacagtgaagagcttgaaattcggtttgaggaatgcccaggcactaaggtccacgtggaggaaacatgtggaacaagaggaccatctctgagatcaaccactgcaagcggaagggtgatcgaggaatggtgctgcagggagtgcacaatgcccccactgtcgttctgggctaaagatggctgttggtatggaatggagataaggcccaggaaagaaccagaaagcaacttagtaaggtcaatggtgactgcaggatcaactgatcacatggatcacttctcccttggagtgcttgtgattctgctcatggtgcaggaagggctgaagaagagaatgaccacaaagatcatcataagcacatcaatggcagtgctggtagctatgatcctgggaggattttcaatgagtgacctggctaagcttgcaattttgatgggtgccaccttcgcggaaatgaacactggaggagatgtagctcatctggcgctgacagcggcattcaaagtcagaccagcgttgctggtatctttcatcttcagagctaattggacaccccgtgaaagcatgctgctggccttggcctcgtgtcttttgcaaactgcgatctctgccttggaaggcgacctgatggttctcatcaatggttttgctttggcctggttggcaatacgagcgatggttgttccacgcactgacaacatcaccttggcaatcctggctgctctgacaccactggcccggggcacactgcttgtggcgtggagagcaggccttgctacttgcggggggtttatgctcctctctctgaagggaaaaggcagtgtgaagaagaacttaccatttgtcatggccctgggactaaccgctgtgaggctggtcgaccccatcaacgtggtgggactgctgttgctcacaaggagtgggaagcggagctggccccctagcgaagtactcacagctgttggcctgatatgtgcattggctggagggttcgccaaggcagatatagagatggctgggcccatggccgcggtcggtctgctaattgtcagttacgtggtctcaggaaagagtgtggacatgtacattgaaagagcaggtgacatcacatgggaaaaagatgcggaagtcactggaaacagtccccggctcgacgtggcgctagatgagagtggtgatttctccctggtggaggatgacggtccccccatgagagagatcatactcaaggtggtcctgatgaccatctgtggcatgaacccaatagccataccctttgcagctggagcgtggtacgtatacgtgaagactggaaaaaggagtggtgctctatgggatgtgcctgctcccaaggaagtaaaaaagggggagaccacagatggagtgtacagagtaatgactcgtagactgctaggttcaacacaagttggagtgggagttatgcaagagggggtctttcacactatgtggcacgtcacaaaaggatccgcgctgagaagcggtgaagggagacttgatccatactggggagatgtcaagcaggatctggtgtcatactgtggtccatggaagctagatgccgcctgggacgggcacagcgaggtgcagctcttggccgtgccccccggagagagagcgaggaacatccagactctgcccggaatatttaagacaaaggatggggacattggagcggttgcgctggattacccagcaggaacttcaggatctccaatcctagacaagtgtgggagagtgataggactttatggcaatggggtcgtgatcaaaaatgggagttatgttagtgccatcacccaagggaggagggaggaagagactcctgttgagtgcttcgagccttcgatgctgaagaagaagcagctaactgtcttagacttgcatcctggagctgggaaaaccaggagagttcttcctgaaatagtccgtgaagccataaaaacaagactccgtactgtgatcttagctccaaccagggttgtcgctgctgaaatggaggaagcccttagagggcttccagtgcgttatatgacaacagcagtcaatgtcacccactctggaacagaaatcgtcgacttaatgtgccatgccaccttcacttcacgtctactacagccaatcagagtccccaactataatctgtatattatggatgaggcccacttcacagatccctcaagtatagcagcaagaggatacatttcaacaagggttgagatgggcgaggcggctgccatcttcatgaccgccacgccaccaggaacccgtgacgcatttccggactccaactcaccaattatggacaccgaagtggaagtcccagagagagcctggagctcaggctttgattgggtgacggatcattctggaaaaacagtttggtttgttccaagcgtgaggaacggcaatgagatcgcagcttgtctgacaaaggctggaaaacgggtcatacagctcagcagaaagacttttgagacagagttccagaaaacaaaacatcaagagtgggactttgtcgtgacaactgacatttcagagatgggcgccaactttaaagctgaccgtgtcatagattccaggagatgcctaaagccggtcatacttgatggcgagagagtcattctggctggacccatgcctgtcacacatgccagcgctgcccagaggagggggcgcataggcaggaatcccaataaacctggagatgagtatctgtatggaggtgggtgcgcagagactgacgaagaccatgcacactggcttgaagcaagaatgctccttgacaatatttacctccaagatggcctcatagcctcgctctatcgacctgaggccgacaaagtagcagccattgagggagagttcaagcttaggacggagcaaaggaagacctttgtggaactcatgaaaagaggagatcttcctgtttggctggcctatcaggttgcatctgccggaataacctacacagatagaagatggtgctttgatggcacgaccaacaacaccataatggaagacagtgtgccggcagaggtgtggaccagacacggagagaaaagagtgctcaaaccgaggtggatggacgccagagtttgttcagatcatgcggccctgaagtcattcaaggagtttgccgctgggaaaagaggagcggcttttggagtgatggaagccctgggaacactgccaggacacatgacagagagattccaggaagccattgacaacctcgctgtgctcatgcgggcagagactggaagcaggccttacaaagccgcggcggcccaattgccggagaccctagagaccattatgcttttggggttgctgggaacagtctcgctgggaatctttttcgtcttgatgaggaacaagggcatagggaagatgggctttggaatggtgactcttggggccagcgcatggctcatgtggctctcggaaattgagccagccagaattgcatgtgtcctcattgttgtgttcctattgctggtggtgctcatacctgagccagaaaagcaaagatctccccaggacaaccaaatggcaatcatcatcatggtagcagtaggtcttctgggcttgattaccgccaatgaactcggatggttggagagaacaaagagtgacctaagccatctaatgggaaggagagaggagggggcaaccataggattctcaatggacattgacctgcggccagcctcagcttgggccatctatgctgccttgacaactttcattaccccagccgtccaacatgcagtgaccacttcatacaacaactactccttaatggcgatggccacgcaagctggagtgttgtttggtatgggcaaagggatgccattctacgcatgggactttggagtcccactgctaatgataggttgctactcacaattaacacccctgaccctaatagtggccatcattttgctcgtggcgcactacatgtacttgatcccagggctgcaggcagcagctgcgcgtgctgcccagaagagaacggcagctggcatcatgaagaaccctgttgtggatggaatagtggtgactgacattgacacaatgacaattgacccccaagtggagaaaaagatgggacaggtgctactcatagcagtagccgtctccagcgccatactgtcgcggaccgcctgggggtggggggaggctggggccctgatcacagccgcaacttccactttgtgggaaggctctccgaacaagtactggaactcctctacagccacttcactgtgtaacatttttaggggaagttacttggctggagcttctctaatctacacagtaacaagaaacgctggcttggtcaagagacgtgggggtggaacaggagagaccctgggagagaaatggaaggcccgcttgaaccagatgtcggccctggagttctactcctacaaaaagtcaggcatcaccgaggtgtgcagagaagaggcccgccgcgccctcaaggacggtgtggcaacgggaggccatgctgtgtcccgaggaagtgcaaagctgagatggttggtggagcggggatacctgcagccctatggaaaggtcattgatcttggatgtggcagagggggctggagttactacgccgccaccatccgcaaagttcaagaagtgaaaggatacacaaaaggaggccctggtcatgaagaacccgtgttggtgcaaagctatgggtggaacatagtccgtcttaagagtggggtggacgtctttcatatggcggctgagccgtgtgacacgttgctgtgtgacataggtgagtcatcatctagtcctgaagtggaagaagcacggacgctcagagtcctctccatggtgggggattggcttgaaaaaagaccaggagccttttgtataaaagtgttgtgcccatacaccagcactatgatggaaaccctggagcgactgcagcgtaggtatgggggaggactggtcagagtgccactctcccgcaactctacacatgagatgtactgggtctctggagcgaaaagcaacaccataaaaagtgtgtccaccacgagccagctcctcttggggcgcatggacgggcctaggaggccagtgaaatatgaggaggatgtgaatctcggctctggcacgcgggctgtggtaagctgcgctgaagctcccaacatgaagatcattggtaaccgcattgaaaggatccgcagtgagcacgcggaaacgtggttctttgacgagaaccacccatataggacatgggcttaccatggaagctatgaggcccccacacaagggtcagcgtcctctctaataaacggggttgtcaggctcctgtcaaaaccctgggatgtggtgactggagtcacaggaatagccatgaccgacaccacaccgtatggtcagcaaagagttttcaaggaaaaagtggacactagggtgccagacccccaagaaggcactcgtcaggttatgagcatggtctcttcctggttgtggaaagagctaggcaaacacaaacggccacgagtctgtaccaaagaagagttcatcaacaaggttcgtagcaatgcagcattaggggcaatatttgaagaggaaaaagagtggaagactgcagtggaagctgtgaacgatccaaggttctgggctctagtggacaaggaaagagagcaccacctgagaggagagtgccagagttgtgtgtacaacatgatgggaaaaagagaaaagaaacaaggggaatttggaaaggccaagggcagccgcgccatctggtatatgtggctaggggctagatttctagagttcgaagcccttggattcttgaacgaggatcactggatggggagagagaactcaggaggtggtgttgaagggctgggattacaaagactcggatatgtcctagaagagatgagtcgcataccaggaggaaggatgtatgcagatgacactgctggctgggacacccgcatcagcaggtttgatctggagaatgaagctctaatcaccaaccaaatggagaaagggcacagggccttggcattggccataatcaagtacacataccaaaacaaagtggtaaaggtccttagaccagctgaaaaagggaaaacagttatggacattatttcgagacaagaccaaagggggagcggacaagttgtcacttacgctcttaacacatttaccaacctagtggtgcaactcattcggaatatggaggctgaggaagttctagagatgcaagacttgtggctgctgcggaggtcagagaaagtgaccaactggttgcagagcaacggatgggataggctcaaacgaatggcagtcagtggagatgattgcgttgtgaagccaattgatgataggtttgcacatgccctcaggttcttgaatgatatgggaaaagttaggaaggacacacaagagtggaaaccctcaactggatgggacaactgggaagaagttccgttttgctcccaccacttcaacaagctccatctcaaggacgggaggtccattgtggttccctgccgccaccaagatgaactgattggccgggcccgcgtctctccaggggcgggatggagcatccgggagactgcttgcctagcaaaatcatatgcgcaaatgtggcagctcctttatttccacagaagggacctccgactgatggccaatgccatttgttcatctgtgccagttgactgggttccaactgggagaactacctggtcaatccatggaaagggagaatggatgaccactgaagacatgcttgtggtgtggaacagagtgtggattgaggagaacgaccacatggaagacaagaccccagttgcgaaatggacagacattccctatttgggaaaaagggaagacttgtggtgtggatctctcatagggcacagaccgcgcaccacctgggctgagaacattaaaaacacagtcaacatggtgcgcaggatcataggtgatgaagaaaagtacatggactacctatccacccaagttcgctacttgggtgaagaagggtctacacctggagtgctgtaagcaccaatcttaatgttgtcaggcctgctagtcagccacagcttggggaaagctgtgcagcctgtgacccccccaggagaagctgggaaaccaagcctatagtcaggccgagaacgccatggcacggaagaagccatgctgcctgtgagcccctcagaggacactgagtcaaaaaaccccacgcgcttggaggcgcaggatgggaaaagaaggtggcgaccttccccacccttcaatctggggcctgaactggagatcagctgtggatctccagaagagggactagtggttagaggag

SEQ ID NO: 69 - DNA, 10617 bp, Zika virus
  Strain H/PF/2013 polyprotein gene, complete cds
agtatcaacaggttttattttggatttggaaacgagagtttctggtcatgaaaaacccaaaaaagaaatccggaggattccggattgtcaatatgctaaaacgcggagtagcccgtgtgagcccctttgggggcttgaagaggctgccagccggacttctgctgggtcatgggcccatcaggatggtcttggcgattctagcctttttgagattcacggcaatcaagccatcactgggtctcatcaatagatggggttcagtggggaaaaaagaggctatggaaataataaagaagttcaagaaagatctggctgccatgctgagaataatcaatgctaggaaggagaagaagagacgaggcgcagatactagtgtcggaattgttggcctcctgctgaccacagctatggcagcggaggtcactagacgtgggagtgcatactatatgtacttggacagaaacgacgctggggaggccatatcttttccaaccacattggggatgaataagtgttatatacagatcatggatcttggacacatgtgtgatgccaccatgagctatgaatgccctatgctggatgagggggtggaaccagatgacgtcgattgttggtgcaacacgacgtcaacttgggttgtgtacggaacctgccatcacaaaaaaggtgaagcacggagatctagaagagctgtgacgctcccctcccattccactaggaagctgcaaacgcggtcgcaaacctggttggaatcaagagaatacacaaagcacttgattagagtcgaaaattggatattcaggaaccctggcttcgcgttagcagcagctgccatcgcttggcttttgggaagctcaacgagccaaaaagtcatatacttggtcatgatactgctgattgccccggcatacagcatcaggtgcataggagtcagcaatagggactttgtggaaggtatgtcaggtgggacttgggttgatgttgtcttggaacatggaggttgtgtcaccgtaatggcacaggacaaaccgactgtcgacatagagctggttacaacaacagtcagcaacatggcggaggtaagatcctactgctatgaggcatcaatatcggacatggcttcggacagccgctgcccaacacaaggtgaagcctaccttgacaagcaatcagacactcaatatgtctgcaaaagaacgttagtggacagaggctggggaaatggatgtggactttttggcaaagggagcctggtgacatgcgctaagtttgcatgctccaagaaaatgaccgggaagagcatccagccagagaatctggagtaccggataatgctgtcagttcatggctcccagcacagtgggatgatcgttaatgacacaggacatgaaactgatgagaatagagcgaaggttgagataacgcccaattcaccaagagccgaagccaccctggggggttttggaagcctaggacttgattgtgaaccgaggacaggccttgacttttcagatttgtattacttgactatgaataacaagcactggttggttcacaaggagtggttccacgacattccattaccttggcacgctggggcagacaccggaactccacactggaacaacaaagaagcactggtagagttcaaggacgcacatgccaaaaggcaaactgtcgtggttctagggagtcaagaaggagcagttcacacggcccttgctggagctctggaggctgagatggatggtgcaaagggaaggctgtcctctggccacttgaaatgtcgcctgaaaatggataaacttagattgaagggcgtgtcatactccttgtgtaccgcagcgttcacattcaccaagatcccggctgaaacactgcacgggacagtcacagtggaggtacagtacgcagggacagatggaccttgcaaggttccagctcagatggcggtggacatgcaaactctgaccccagttgggaggttgataaccgctaaccccgtaatcactgaaagcactgagaactctaagatgatgctggaacttgatccaccatttggggactcttacattgtcataggagtcggggagaagaagatcacccaccactggcacaggagtggcagcaccattggaaaagcatttgaagccactgtgagaggtgccaagagaatggcagtcttgggagacacagcctgggactttggatcagttggaggcgctctcaactcattgggcaagggcatccatcaaatttttggagcagctttcaaatcattgtttggaggaatgtcctggttctcacaaattctcattggaacgttgctgatgtggttgggtctgaacacaaagaatggatctatttcccttatgtgcttggccttagggggagtgttgatcttcttatccacagctgtctctgctgatgtggggtgctcggtggacttctcaaagaaggagacgagatgcggtacaggggtgttcgtctataacgacgttgaagcctggagggacaggtacaagtaccatcctgactccccccgtagattggcagcagcagtcaagcaagcctgggaagatggtatctgtgggatctcctctgtttcaagaatggaaaacatcatgtggagatcagtagaaggggagctcaacgcaatcctggaagagaatggagttcaactgacggtcgttgtgggatctgtaaaaaaccccatgtggagaggtccacagagattgcccgtgcctgtgaacgagctgccccacggctggaaggcttgggggaaatcgtacttcgtcagagcagcaaagacaaataacagctttgtcgtggatggtgacacactgaaggaatgcccactcaaacatagagcatggaacagctttcttgtggaggatcatgggttcggggtatttcacactagtgtctggctcaaggttagagaagattattcattagagtgtgatccagccgttattggaacagctgttaagggaaaggaggctgtacacagtgatctaggctactggattgagagtgagaagaatgacacatggaggctgaagagggcccatctgatcgagatgaaaacatgtgaatggccaaagtcccacacattgtggacagatggaatagaagagagtgatctgatcatacccaagtctttagctgggccactcagccatcacaataccagagagggctacaggacccaaatgaaagggccatggcacagtgaagagcttgaaattcggtttgaggaatgcccaggcactaaggtccacgtggaggaaacatgtggaacaagaggaccatctctgagatcaaccactgcaagcggaagggtgatcgaggaatggtgctgcagggagtgcacaatgcccccactgtcgttccgggctaaagatggctgttggtatggaatggagataaggcccaggaaagaaccagaaagtaacttagtaaggtcaatggtgactgcaggatcaactgatcacatggatcacttctcccttggagtgcttgtgattctgctcatggtgcaggaagggctgaagaagagaatgaccacaaagatcatcataagcacatcgatggcagtgctggtagctatgatcctgggaggattttcaatgagtgacctggctaagcttgcaattttgatgggtgccaccttcgcggaaatgaacactggaggagatgtagctcatctggcgctgatagcggcattcaaagtcagaccagcgttgctggtatctttcatcttcagagctaattggacaccccgtgaaagcatgctgctggccttggcctcgtgtcttttgcaaactgcgatctccgccttggaaggcgacctgatggttctcatcaatggttttgctttggcctggttggcaatacgagcgatggttgttccacgcactgataacatcaccttggcaatcctggctgctctgacaccactggcccggggcacactgcttgtggcgtggagagcaggccttgctacttgcggggggtttatgctcctctctctgaagggaaaaggcagtgtgaagaagaacttaccatttgtcatggccctgggactaaccgctgtgaggctggtcgaccccatcaacgtggtgggactgctgttgctcacaaggagtgggaagcggagctggccccctagcgaagtactcacagctgttggcctgatatgcgcattggctggagggttcgccaaggcagatatagagatggctgggcccatggccgcggtcggtctgctaattgtcagttacgtggtctcaggaaagagtgtggacatgtacattgaaagagcaggtgacatcacatgggaaaaagatgcggaagtcactggaaacagtccccggctcgatgtggcgctagatgagagtggtgatttctccctggtggaggatgacggtccccccatgagagagatcatactcaaggtggtcctgatgaccatctgtggcatgaacccaatagccataccctttgcagctggagcgtggtacgtatacgtgaagactggaaaaaggagtggtgctctatgggatgtgcctgctcccaaggaagtaaaaaagggggagaccacagatggagtgtacagagtaatgactcgtagactgctaggttcaacacaagttggagtgggagttatgcaagagggggtctttcacactatgtggcacgtcacaaaaggatccgcgctgagaagcggtgaagggagacttgatccatactggggagatgtcaagcaggatctggtgtcatactgtggtccatggaagctagatgccgcctgggacgggcacagcgaggtgcagctcttggccgtgccccccggagagagagcgaggaacatccagactctgcccggaatatttaagacaaaggatggggacattggagcggttgcgctggattacccagcaggaacttcaggatctccaatcctagacaagtgtgggagagtgataggactttatggcaatggggtcgtgatcaaaaatgggagttatgttagtgccatcacccaagggaggagggaggaagagactcctgttgagtgcttcgagccttcgatgctgaagaagaagcagctaactgtcttagacttgcatcctggagctgggaaaaccaggagagttcttcctgaaatagtccgtgaagccataaaaacaagactccgtactgtgatcttagctccaaccagggttgtcgctgctgaaatggaggaagcccttagagggcttccagtgcgttatatgacaacagcagtcaatgtcacccactctggaacagaaatcgtcgacttaatgtgccatgccaccttcacttcacgtctactacagccaatcagagtccccaactataatctgtatattatggatgaggcccacttcacagatccctcaagtatagcagcaagaggatacatttcaacaagggttgagatgggcgaggcggctgccatcttcatgaccgccacgccaccaggaacccgtgacgcatttccggactccaactcaccaattatggacaccgaagtggaagtcccagagagagcctggagctcaggctttgattgggtgacggatcattctggaaaaacagtttggtttgttccaagcgtgaggaacggcaatgagatcgcagcttgtctgacaaaggctggaaaacgggtcatacagctcagcagaaagacttttgagacagagttccagaaaacaaaacatcaagagtgggactttgtcgtgacaactgacatttcagagatgggcgccaactttaaagctgaccgtgtcatagattccaggagatgcctaaagccggtcatacttgatggcgagagagtcattctggctggacccatgcctgtcacacatgccagcgctgcccagaggagggggcgcataggcaggaatcccaacaaacctggagatgagtatctgtatggaggtgggtgcgcagagactgacgaagaccatgcacactggcttgaagcaagaatgctccttgacaatatttacctccaagatggcctcatagcctcgctctatcgacctgaggccgacaaagtagcagccattgagggagagttcaagcttaggacggagcaaaggaagacctttgtggaactcatgaaaagaggagatcttcctgtttggctggcctatcaggttgcatctgccggaataacctacacagatagaagatggtgctttgatggcacgaccaacaacaccataatggaagacagtgtgccggcagaggtgtggaccagacacggagagaaaagagtgctcaaaccgaggtggatggacgccagagtttgttcagatcatgcggccctgaagtcattcaaggagtttgccgctgggaaaagaggagcggcttttggagtgatggaagccctgggaacactgccaggacacatgacagagagattccaggaagccattgacaacctcgctgtgctcatgcgggcagagactggaagcaggccttacaaagccgcggcggcccaattgccggagaccctagagaccattatgcttttggggttgctgggaacagtctcgctgggaatctttttcgtcttgatgaggaacaagggcatagggaagatgggctttggaatggtgactcttggggccagcgcatggctcatgtggctctcggaaattgagccagccagaattgcatgtgtcctcattgttgtgttcctattgctggtggtgctcatacctgagccagaaaagcaaagatctccccaggacaaccaaatggcaatcatcatcatggtagcagtaggtcttctgggcttgattaccgccaatgaactcggatggttggagagaacaaagagtgacctaagccatctaatgggaaggagagaggagggggcaaccataggattctcaatggacattgacctgcggccagcctcagcttgggccatctatgctgccttgacaactttcattaccccagccgtccaacatgcagtgaccacttcatacaacaactactccttaatggcgatggccacgcaagctggagtgttgtttggtatgggcaaagggatgccattctacgcatgggactttggagtcccgctgctaatgataggttgctactcacaattaacacccctgaccctaatagtggccatcattttgctcgtggcgcactacatgtacttgatcccagggctgcaggcagcagctgcgcgtgctgcccagaagagaacggcagctggcatcatgaagaaccctgttgtggatggaatagtggtgactgacattgacacaatgacaattgacccccaagtggagaaaaagatgggacaggtgctactcatagcagtagccgtctccagcgccatactgtcgcggaccgcctgggggtggggggaggctggggccctgatcacagcggcaacttccactttgtgggaaggctctccgaacaagtactggaactcctctacagccacttcactgtgtaacatttttaggggaagttacttggctggagcttctctaatctacacagtaacaagaaacgctggcttggtcaagagacgtgggggtggaacaggagagaccctgggagagaaatggaaggcccgcttgaaccagatgtcggccctggagttctactcctacaaaaagtcaggcatcaccgaggtgtgcagagaagaggcccgccgcgccctcaaggacggtgtggcaacgggaggccatgctgtgtcccgaggaagtgcaaagctgagatggttggtggagcggggatacctgcagccctatggaaaggtcattgatcttggatgtggcagagggggctggagttactacgccgccaccatccgcaaagttcaagaagtgaaaggatacacaaaaggaggccctggtcatgaagaacccatgttggtgcaaagctatgggtggaacatagtccgtcttaagagtggggtggacgtctttcatatggcggctgagccgtgtgacacgttgctgtgtgacataggtgagtcatcatctagtcctgaagtggaagaagcacggacgctcagagtcctctccatggtgggggattggcttgaaaaaagaccaggagccttttgtataaaagtgttgtgcccatacaccagcactatgatggaaaccctggagcgactgcagcgtaggtatgggggaggactggtcagagtgccactctcccgcaactctacacatgagatgtactgggtctctggagcgaaaagcaacaccataaaaagtgtgtccaccacgagccagctcctcttggggcgcatggacgggcccaggaggccagtgaaatatgaggaggatgtgaatctcggctctggcacgcgggctgtggtaagctgcgctgaagctcccaacatgaagatcattggtaaccgcattgaaaggatccgcagtgagcacgcggaaacgtggttctttgacgagaaccacccatataggacatgggcttaccatggaagctatgaggcccccacacaagggtcagcgtcctctctaataaacggggttgtcaggctcctgtcaaaaccctgggatgtggtgactggagtcacaggaatagccatgaccgacaccacaccgtatggtcagcaaagagttttcaaggaaaaagtggacactagggtgccagacccccaagaaggcactcgtcaggttatgagcatggtctcttcctggttgtggaaagagctaggcaaacacaaacggccacgagtctgtaccaaagaagagttcatcaacaaggttcgtagcaatgcagcattaggggcaatatttgaagaggaaaaagagtggaagactgcagtggaagctgtgaacgatccaaggttctgggctctagtggacaaggaaagagagcaccacctgagaggagagtgccagagttgtgtgtacaacatgatgggaaaaagagaaaagaaacaaggggaatttggaaaggccaagggcagccgcgccatctggtatatgtggctaggggctagatttctagagttcgaagcccttggattcttgaacgaggatcactggatggggagagagaactcaggaggtggtgttgaagggctgggattacaaagactcggatatgtcctagaagagatgagtcgcataccaggaggaaggatgtatgcagatgacactgctggctgggacacccgcatcagcaggtttgatctggagaatgaagctctaatcaccaaccaaatggagaaagggcacagggccttggcattggccataatcaagtacacataccaaaacaaagtggtaaaggtccttagaccagctgaaaaagggaagacagttatggacattatttcgagacaagaccaaagggggagcggacaagttgtcacttacgctcttaacacatttaccaacctagtggtgcaactcattcggaatatggaggctgaggaagttctagagatgcaagacttgtggctgctgcggaggtcagagaaagtgaccaactggttgcagagcaacggatgggataggctcaaacgaatggcagtcagtggagatgattgcgttgtgaagccaattgatgataggtttgcacatgccctcaggttcttgaatgatatgggaaaagttaggaaggacacacaagagtggaaaccctcaactggatgggacaactgggaagaagttccgttttgctcccaccacttcaacaagctccatctcaaggacgggaggtccattgtggttccctgccgccaccaagatgaactgattggccgggcccgcgtctctccaggggcgggatggagcatccgggagactgcttgcctagcaaaatcatatgcgcaaatgtggcagctcctttatttccacagaagggacctccgactgatggccaatgccatttgttcatctgtgccagttgactgggttccaactgggagaactacctggtcaatccatggaaagggagaatggatgaccactgaagacatgcttgtggtgtggaacagagtgtggattgaggagaacgaccacatggaagacaagaccccagttacgaaatggacagacattccctatttgggaaaaagggaagacttgtggtgtggatctctcatagggcacagaccgcgcaccacctgggctgagaacattaaaaacacagtcaacatggtgcgcaggatcataggtgatgaagaaaagtacatggactacctatccacccaagttcgctacttgggtgaagaagggtctacacctggagtgctgtaagcaccaatcttagtgttgtcaggcctgctagtcagccacagcttggggaaagctgtgcagcctgtgacccccccaggagaagctgggaaaccaagcctatagtcaggccgagaacgccatggcacggaagaagccatgctgcctgtgagcccctcagaggacactgagtcaaaaaaccccacgcgcttggaggcgcaggatgggaaaagaaggtggcgaccttccccacccttcaatctggggcctgaactggagatcagctgtggatctccagaagagggactagtggttagaggag

SEQ ID NO: 70 - DNA, 10766 bp, Zika virus
  Strain MR 766 polyprotein gene, complete cds
gatctgtgtgagtcagactgcgacagttcgagtctgaagcgagagctaacaacagtatcaacaggtttaatttggatttggaaacgagagtttctggtcatgaaaaacccaaagaagaaatccggaggattccggattgtcaatatgctaaaacgcggagtagcccgtgtaaaccccttgggaggtttgaagaggttgccagccggacttctgctgggtcatggacccatcagaatggttttggcgatactagcctttttgagatttacagcaatcaagccatcactgggccttatcaacagatggggttccgtggggaaaaaagaggctatggaaataataaagaagttcaagaaagatcttgctgccatgttgagaataatcaatgctaggaaagagaggaagagacgtggcgcagacaccagcatcggaatcattggcctcctgctgactacagccatggcagcagagatcactagacgcgggagtgcatactacatgtacttggataggagcgatgccgggaaggccatttcgtttgctaccacattgggagtgaacaagtgccacgtacagatcatggacctcgggcacatgtgtgacgccaccatgagttatgagtgccctatgctggatgagggagtggaaccagatgatgtcgattgctggtgcaacacgacatcaacttgggttgtgtacggaacctgtcatcacaaaaaaggtgaggcacggcgatctagaagagccgtgacgctcccttctcactctacaaggaagttgcaaacgcggtcgcagacctggttagaatcaagagaatacacgaagcacttgatcaaggttgaaaactggatattcaggaaccccgggtttgcgctagtggccgttgccattgcctggcttttgggaagctcgacgagccaaaaagtcatatacttggtcatgatactgctgattgccccggcatacagtatcaggtgcattggagtcagcaatagagacttcgtggagggcatgtcaggtgggacctgggttgatgttgtcttggaacatggaggctgcgttaccgtgatggcacaggacaagccaacagttgacatagagttggtcacgacgacggttagtaacatggccgaggtaagatcctattgctacgaggcatcgatatcggacatggcttcggacagtcgttgcccaacacaaggtgaagcctaccttgacaagcaatcagacactcaatatgtctgcaaaagaacattagtggacagaggttggggaaacggttgtggactttttggcaaagggagcttggtgacatgtgccaagtttacgtgttctaagaagatgaccgggaagagcattcaaccggaaaatctggagtatcggataatgctatcagtgcatggctcccagcatagcgggatgattgtcaatgatacaggatatgaaactgacgaaaatagagcgaaagtcgaggttacgcctaattcaccaagagcggaagcaaccttgggaggctttggaagcttaggacttgactgtgaaccaaggacaggccttgacttttcagatctgtattacctgaccatgaacaataagcattggttggtgcacaaagagtggtttcatgacatcccattgccttggcatgctggggcagacaccggaactccacactggaacaacaaagaggcattggtagaattcaaggatgcccacgccaagaggcaaaccgtcgtcgttctggggagccaggaaggagccgttcacacggctctcgctggagctctagaggctgagatggatggtgcaaagggaaagctgttctctggccatttgaaatgccgcctaaaaatggacaagcttagattgaagggcgtgtcatattccttgtgcactgcggcattcacattcaccaaggtcccagctgaaacactgcatggaacagtcacagtggaggtgcagtatgcagggacagatggaccctgcaagatcccagtccagatggcggtggacatgcagaccctgaccccagttggaaggctgataaccgccaaccccgtgattactgaaagcactgagaactcaaagatgatgttggagcttgacccaccatttggggattcttacattgtcataggagttggggacaagaaaatcacccaccactggcataggagtggtagcaccatcggaaaggcatttgaggccactgtgagaggcgccaagagaatggcagtcctgggggatacagcctgggacttcggatcagtcgggggtgtgttcaactcactgggtaagggcattcaccagatttttggagcagccttcaaatcactgtttggaggaatgtcctggttctcacagatcctcataggcacgctgctagtgtggttaggtttgaacacaaagaatggatctatctccctcacatgcttggccctggggggagtgatgatcttcctctccacggctgtttctgctgacgtggggtgctcagtggacttctcaaaaaaggaaacgagatgtggcacgggggtattcatctataatgatgttgaagcctggagggaccggtacaagtaccatcctgactccccccgcagattggcagcagcagtcaagcaggcctgggaagaggggatctgtgggatctcatccgtttcaagaatggaaaacatcatgtggaaatcagtagaaggggagctcaatgctatcctagaggagaatggagttcaactgacagttgttgtgggatctgtaaaaaaccccatgtggagaggtccacaaagattgccagtgcctgtgaatgagctgccccatggctggaaagcctgggggaaatcgtattttgttagggcggcaaagaccaacaacagttttgttgtcgacggtgacacactgaaggaatgtccgcttgagcacagagcatggaatagttttcttgtggaggatcacgggtttggagtcttccacaccagtgtctggcttaaggtcagagaagattactcattagaatgtgacccagccgtcataggaacagctgttaagggaagggaggccgcgcacagtgatctgggctattggattgaaagtgaaaagaatgacacatggaggctgaagagggcccacctgattgagatgaaaacatgtgaatggccaaagtctcacacattgtggacagatggagtagaagaaagtgatcttatcatacccaagtctttagctggtccactcagccaccacaacaccagagagggttacagaacccaagtgaaagggccatggcacagtgaagagcttgaaatccggtttgaggaatgtccaggcaccaaggtttacgtggaggagacatgcggaactagaggaccatctctgagatcaactactgcaagtggaagggtcattgaggaatggtgctgtagggaatgcacaatgcccccactatcgtttcgagcaaaagacggctgctggtatggaatggagataaggcccaggaaagaaccagagagcaacttagtgaggtcaatggtgacagcggggtcaaccgatcatatggaccacttctctcttggagtgcttgtgattctactcatggtgcaggaggggttgaagaagagaatgaccacaaagatcatcatgagcacatcaatggcagtgctggtagtcatgatcttgggaggattttcaatgagtgacctggccaagcttgtgatcctgatgggtgctactttcgcagaaatgaacactggaggagatgtagctcacttggcattggtagcggcatttaaagtcagaccagccttgctggtctccttcattttcagagccaattggacaccccgtgagagcatgctgctagccctggcttcgtgtcttctgcaaactgcgatctctgctcttgaaggtgacttgatggtcctcattaatggatttgctttggcctggttggcaattcgagcaatggccgtgccacgcactgacaacatcgctctaccaatcttggctgctctaacaccactagctcgaggcacactgctcgtggcatggagagcgggcctggctacttgtggagggatcatgctcctctccctgaaagggaaaggtagtgtgaagaagaacctgccatttgtcatggccctgggattgacagctgtgagggtagtagaccctattaatgtggtaggactactgttactcacaaggagtgggaagcggagctggccccctagtgaagttctcacagccgttggcctgatatgtgcactggccggagggtttgccaaggcagacattgagatggctggacccatggctgcagtaggcttgctaattgtcagctatgtggtctcgggaaagagtgtggacatgtacattgaaagagcaggtgacatcacatgggaaaaggacgcggaagtcactggaaacagtcctcggcttgacgtggcactggatgagagtggtgatttctccttggtagaggaagatggtccacccatgagagagatcatactcaaggtggtcctgatggccatctgtggcatgaacccaatagctataccttttgctgcaggagcgtggtatgtgtatgtgaagactgggaaaaggagtggcgccctctgggacgtgcctgctcccaaagaagtgaagaaaggagagaccacagatggagtgtacagagtgatgactcgcagactgctaggttcaacacaggttggagtgggagtcatgcaagagggagtcttccacaccatgtggcacgttacaaaaggagccgcactgaggagcggtgagggaagacttgatccatactggggggatgtcaagcaggacttggtgtcatactgtgggccttggaagttggatgcagcttgggatggactcagcgaggtacagcttttggccgtacctcccggagagagggccagaaacattcagaccctgcctggaatattcaagacaaaggacggggacatcggagcagttgctctggactaccctgcagggacctcaggatctccgatcctagacaaatgtggaagagtgataggactctatggcaatggggttgtgatcaagaatggaagctatgttagtgctataacccagggaaagagggaggaggagactccggttgaatgtttcgaaccctcgatgctgaagaagaagcagctaactgtcttggatctgcatccaggagccggaaaaaccaggagagttcttcctgaaatagtccgtgaagccataaaaaagagactccggacagtgatcttggcaccaactagggttgtcgctgctgagatggaggaggccttgagaggacttccggtgcgttacatgacaacagcagtcaacgtcacccattctgggacagaaatcgttgatttgatgtgccatgccactttcacttcacgcttactacaacccatcagagtccctaattacaatctctacatcatggatgaagcccacttcacagacccctcaagtatagctgcaagaggatacatatcaacaagggttgaaatgggcgaggcggctgccatttttatgactgccacaccaccaggaacccgtgatgcgtttcctgactctaactcaccaatcatggacacagaagtggaagtcccagagagagcctggagctcaggctttgattgggtgacagaccattctgggaaaacagtttggttcgttccaagcgtgagaaacggaaatgaaatcgcagcctgtctgacaaaggctggaaagcgggtcatacagctcagcaggaagacttttgagacagaatttcagaaaacaaaaaatcaagagtgggactttgtcataacaactgacatctcagagatgggcgccaacttcaaggctgaccgggtcatagactctaggagatgcctaaaaccagtcatacttgatggtgagagagtcatcttggctgggcccatgcctgtcacgcatgctagtgctgctcagaggagaggacgtataggcaggaaccctaacaaacctggagatgagtacatgtatggaggtgggtgtgcagagactgatgaaggccatgcacactggcttgaagcaagaatgcttcttgacaacatctacctccaggatggcctcatagcctcgctctatcggcctgaggccgataaggtagccgccattgagggagagtttaagctgaggacagagcaaaggaagaccttcgtggaactcatgaagagaggagaccttcccgtctggctagcctatcaggttgcatctgccggaataacttacacagacagaagatggtgctttgatggcacaaccaacaacaccataatggaagacagcgtaccagcagaggtgtggacaaagtatggagagaagagagtgctcaaaccgagatggatggatgctagggtctgttcagaccatgcggccctgaagtcgttcaaagaattcgccgctggaaaaagaggagcggctttgggagtaatggaggccctgggaacactgccaggacacatgacagagaggtttcaggaagccattgacaacctcgccgtgctcatgcgagcagagactggaagcaggccttataaggcagcggcagcccaactgccggagaccctagagaccattatgctcttaggtttgctgggaacagtttcactggggatcttcttcgtcttgatgcggaataagggcatcgggaagatgggctttggaatggtaacccttggggccagtgcatggctcatgtggctttcggaaattgaaccagccagaattgcatgtgtcctcattgttgtgtttttattactggtggtgctcatacccgagccagagaagcaaagatctccccaagataaccagatggcaattatcatcatggtggcagtgggccttctaggtttgataactgcaaacgaacttggatggctggaaagaacaaaaaatgacatagctcatctaatgggaaggagagaagaaggagcaaccatgggattctcaatggacattgatctgcggccagcctccgcctgggctatctatgccgcattgacaactctcatcaccccagctgtccaacatgcggtaaccacttcatacaacaactactccttaatggcgatggccacacaagctggagtgctgtttggcatgggcaaagggatgccattttatgcatgggaccttggagtcccgctgctaatgatgggttgctattcacaattaacacccctgactctgatagtagctatcattctgcttgtggcgcactacatgtacttgatcccaggcctacaagcggcagcagcgcgtgctgcccagaaaaggacagcagctggcatcatgaagaatcccgttgtggatggaatagtggtaactgacattgacacaatgacaatagacccccaggtggagaagaagatgggacaagtgttactcatagcagtagccatctccagtgctgtgctgctgcggaccgcctggggatggggggaggctggagctctgatcacagcagcgacctccaccttgtgggaaggctctccaaacaaatactggaactcctctacagccacctcactgtgcaacatcttcagaggaagctatctggcaggagcttcccttatctatacagtgacgagaaacgctggcctggttaagagacgtggaggtgggacgggagagactctgggagagaagtggaaagctcgtctgaatcagatgtcggccctggagttctactcttataaaaagtcaggtatcactgaagtgtgtagagaggaggctcgccgtgccctcaaggatggagtggccacaggaggacatgccgtatcccggggaagtgcaaagctcagatggttggtggagagaggatatctgcagccctatgggaaggttgttgacctcggatgtggcagagggggctggagctattatgccgccaccatccgcaaagtgcaggaggtgagaggatacacaaagggaggtcccggtcatgaagaacccatgctggtgcaaagctatgggtggaacatagttcgtctcaagagtggagtggacgtcttccacatggcggctgagccgtgtgacactctgctgtgtgacataggtgagtcatcatctagtcctgaagtggaagagacacgaacactcagagtgctctctatggtgggggactggcttgaaaaaagaccaggggccttctgtataaaggtgctgtgcccatacaccagcactatgatggaaaccatggagcgactgcaacgtaggcatgggggaggattagtcagagtgccattgtctcgcaactccacacatgagatgtactgggtctctggggcaaagagcaacatcataaaaagtgtgtccaccacaagtcagctcctcctgggacgcatggatggccccaggaggccagtgaaatatgaggaggatgtgaacctcggctcgggtacacgagctgtggcaagctgtgctgaggctcctaacatgaaaatcatcggcaggcgcattgagagaatccgcaatgaacatgcagaaacatggtttcttgatgaaaaccacccatacaggacatgggcctaccatgggagctacgaagcccccacgcaaggatcagcgtcttccctcgtgaacggggttgttagactcctgtcaaagccttgggacgtggtgactggagttacaggaatagccatgactgacaccacaccatacggccaacaaagagtcttcaaagaaaaagtggacaccagggtgccagatccccaagaaggcactcgccaggtaatgaacatagtctcttcctggctgtggaaggagctggggaaacgcaagcggccacgcgtctgcaccaaagaagagtttatcaacaaggtgcgcagcaatgcagcactgggagcaatatttgaagaggaaaaagaatggaagacggctgtggaagctgtgaatgatccaaggttttgggccctagtggatagggagagagaacaccacctgagaggagagtgtcacagctgtgtgtacaacatgatgggaaaaagagaaaagaagcaaggagagttcgggaaagcaaaaggtagccgcgccatctggtacatgtggttgggagccagattcttggagtttgaagcccttggattcttgaacgaggaccattggatgggaagagaaaactcaggaggtggagtcgaagggttaggattgcaaagacttggatacattctagaagaaatgaatcgggcaccaggaggaaagatgtacgcagatgacactgctggctgggacacccgcattagtaagtttgatctggagaatgaagctctgattaccaaccaaatggaggaagggcacagaactctggcgttggccgtgattaaatacacataccaaaacaaagtggtgaaggttctcagaccagctgaaggaggaaaaacagttatggacatcatttcaagacaagaccagagagggagtggacaagttgtcacttatgctctcaacacattcaccaacttggtggtgcagcttatccggaacatggaagctgaggaagtgttagagatgcaagacttatggttgttgaggaagccagagaaagtgaccagatggttgcagagcaatggatgggatagactcaaacgaatggcggtcagtggagatgactgcgttgtgaagccaatcgatgataggtttgcacatgccctcaggttcttgaatgacatgggaaaagttaggaaagacacacaggagtggaaaccctcgactggatggagcaattgggaagaagtcccgttctgctcccaccacttcaacaagctgtacctcaaggatgggagatccattgtggtcccttgccgccaccaagatgaactgattggccgagctcgcgtctcaccaggggcaggatggagcatccgggagactgcctgtcttgcaaaatcatatgcgcagatgtggcagctcctttatttccacagaagagaccttcgactgatggctaatgccatttgctcggctgtgccagttgactgggtaccaactgggagaaccacctggtcaatccatggaaagggagaatggatgaccactgaggacatgctcatggtgtggaatagagtgtggattgaggagaacgaccatatggaggacaagactcctgtaacaaaatggacagacattccctatctaggaaaaagggaggacttatggtgtggatcccttatagggcacagaccccgcaccacttgggctgaaaacatcaaagacacagtcaacatggtgcgcaggatcataggtgatgaagaaaagtacatggactatctatccacccaagtccgctacttgggtgaggaagggtccacacccggagtgttgtaagcaccaattttagtgttgtcaggcctgctagtcagccacagtttggggaaagctgtgcagcctgtaacccccccaggagaagctgggaaaccaagctcatagtcaggccgagaacgccatggcacggaagaagccatgctgcctgtgagcccctcagaggacactgagtcaaaaaaccccacgcgcttggaagcgcaggatgggaaaagaaggtggcgaccttccccacccttcaatctggggcctgaactggagactagctgtgaatctccagcagagggactagtggttagaggagaccccccggaaaacgcacaacagcatattgacgctgggaaagaccagagactccatgagtttccaccacgctggccgccaggcacagatcgccgaac

SEQ ID NO: 71 - DNA, 10272 bp, Zika virus
  Strain 8375 polyprotein gene, complete cds
atgaaaaacccaaaaaagaaatccggaggattccggattgtcaatatgctaaaacgcggagtagcccgtgtgagcccctttgggggcttgaagaggctgccagccggacttctgctgggtcatgggcccatcaggatggtcttggcgattctagcctttttgagattcacggcaatcaagccatcactgggtctcatcaatagatggggttcagtggggaaaaaagaggctatggaaataataaagaagttcaagaaagatctggctgccatgctgagaataatcaatgctaggaaggagaagaagagacgaggcgcagatactagtgtcggaattgttggcctcctgctgaccacagctatggcagcggaggtcactagacgtgggagtgcatactatatgtacttggacagaaacgatgctggggaggccatatcttttccaaccacattggggatgaataagtgttatatacagatcatggatcttggacacatgtgtgatgccaccatgagctatgaatgccctatgctggatgagggggtggaaccagatgacgtcgattgttggtgcaacacgacgtcaacttgggttgtgtacggaacctgccatcacaaaaaaggtgaagcacggagatctagaagagctgtgacgctcccctcccattccactaggaagctgcaaacgcggtcgcaaacctggttggaatcaagagaatacacaaagcacttgattagagtcgaaaattggatattcaggaaccctggcttcgcgttagcagcagctgccatcgcttggcttttgggaagctcaacgagccaaaaagtcatatacttggtcatgatactgctgattgccccggcatacagcatcaggtgcataggagtcagcaatagggactttgtggaaggtatgtcaggtgggacttgggttgatgttgtcttggaacatggaggttgtgtcaccgtaatggcacaggacaaaccgactgtcgacatagagctggttacaacaacagtcagcaacatggcggagataagatcctactgctatgaggcatcaatatcagacatggcttcggacagccgctgcccaacacaaggtgaagcctaccttgacaagcaatcagacactcaatatgtctgcaaaagaacgttagtggacagaggctggggaaatggatgtggactttttggcaaagggagcctggtgacatgcgctaagtttgcatgctccaagaaaatgaccgggaagagcatccagccagagaatctggagtaccggataatgctgtcagttcatggctcccagcacagtgggatgatcgttaatgacacaggacatgaaactgatgagaatagagcgaaggttgagataacgcccaattcaccaagagccgaagccaccctggggggttttggaagcctaggacttgattgtgaaccgaggacaggccttgacttttcagatttgtattacttgactatgaataacaagcactggttggttcacaaggagtggttccacgacattccattaccttggcacgctggggcagacaccggaactccacactggaacaacaaagaagcactggtggagttcaaggacgcacatgccaaaaggcaaactgtcgtggttctagggagtcaagaaggagcagttcacacggcccttgctggagctctggaggctgagatggatggtgcaaagggaaggctgtcctctggccacttgaaatgtcgcctgaaaatggataaacttagattgaagggcgtgtcatactccttgtgtaccgcagcgttcacattcaccaagatcccggctgaaacactgcacgggacagtcacagtggaggtacagtacgcagggacagatggaccttgcaaggttccagctcagatggcggtggacatgcaaactctgaccccagttgggaggttgataaccgctaaccccgtaatcactgaaagcactgagaactctaagatgatgctggaacttgatccaccatttggggactcttacattgtcataggagtcggggagaagaagatcacccaccactggcacaggagtggcagcaccattggaaaagcatttgaagccactgtgagaggtgccaagagaatggcagtcttgggagacacagcctgggactttggatcagttggaggcgctctcaactcattgggcaagggcatccatcaaatttttggagctgctttcaaatcattgtttggaggaatgtcctggttctcacaaattctcattggaacgttgctgatgtggttgggtctgaacacaaagaatggatctatttcccttatgtgcttggccttagggggagtgttgatcttcttatccacagccgtctctgctgatgtggggtgctcggtggacttctcaaagaaggagacgagatgcggtacaggggtgttcgtctataacgacgttgaagcctggagggacaggtacaagtaccatcctgactccccccgtagattggcagcagcagtcaagcaagcctgggaagatggtatctgcgggatctcctctgtttcaagaatggaaaacatcatgtggagatcagtagaaggggagctcaacgcaatcctggaagagaatggagttcaactgacggtcgttgtgggatctgtaaaaaaccccatgtggagagctccacagagattgcccgtgcctgtgaacgagctgccccacggctggaaggcttgggggaaatcgtacttcgtcagagcagcaaagacaaataacagctttgtcgtggatggtgacacactgaaggaatgcccactcaaacatagagcatggaacagctttcttgtggaggatcatgggttcggggtatttcacactagtgtctggctcaaggttagagaagattattcattagagtgtgatccagccgttattggaacagctgttaagggaaaggaggctgtacacagtgatctaggctactggattgagagtgagaagaatgacacatggaggctgaagagggcccatctgatcgagatgaaaacatgtgaatggccaaagtcccacacattgtggacagatggaatagaagagagtgatctgatcatacccaagtctttagctgggccactcagccatcacaataccagagagggctacaggacccaaatgaaagggccatggcacagtgaagagcttgaaattcggtttgaggaatgcccaggcactaaggtccacgtggaggaaacatgtggaacaagaggaccatctctgagatcaaccactgcaagcggaagggtgatcgaggaatggtgctgcagggagtgcacaatgcccccactgtcgttccgggctaaagatggctgttggtatggaatggagataaggcccaggaaagaaccagaaagcaacttagtaaggtcaatggtgactgcaggatcaactgatcacatggatcacttctcccttggagtgcttgtgattctgctcatggtgcaggaagggctaaagaagagaatgaccacaaagatcatcataagcacatcaatggcagtgctggtagctatgatcctgggaggattttcaatgagtgacctggctaagcttgcaattttgatgggtgccaccttcgcggaaatgaacactggaggagatgtagctcatctggcgctgatagcggcattcaaagtcagaccagcgttgctggtatctttcatcttcagagctaattggacaccccgtgaaagcatgctactggccttggcctcgtgtcttttgcaaactgcgatctccgccttggaaggcgacctgatggttctcatcaatggttttgctttggcctggttggcaatacgagcgatggttgttccacgcactgataacatcaccttggcaatcctggctgctctgacaccactggcccggggcacactgcttgtggcgtggagagcaggccttgctacttgcggggggtttatgctcctctctctgaagggaaaaggcagtgtgaagaagaacttaccatttgtcatggccctgggactaaccgctgtgaggctggtcgaccccatcaacgtggtgggactgctgttgctcacaaggagtgggaagcggagctggccccctagcgaagtactcacagctgttggcctgatatgcgcattggctggagggttcgccaaggcagatatagagatggctgggcccatggccgcggtcggtctgctaattgtcagttacgtggtctcaggaaagagtgtggacatgtacattgaaagagcaggtgacatcacatgggaaaaagatgcggaagtcactggaaacagtccccggctcgatgtggcgctagatgagagtggtgatttctccctggtggaggatgacggtccccccatgagagagatcatactcaaggtggtcctgatgaccatctgtggcatgaacccaatagccataccctttgcagctggagcgtggtacgtatacgtgaagactggaaaaaggagtggtgctctatgggatgtgcctgctcccaaggaagtaaaaaagggggagaccacagatggagtgtacagagtaatgactcgtagactgctaggttcaacacaagttggagtgggagttatgcaagagggggtctttcacactatgtggcacgtcacaaaaggatccgcactgagaagcggtgaagggagacttgatccatactggggagatgtcaagcaggatctggtgtcatactgtggtccatggaagctagatgccgcctgggacgggcacagcgaggtgcagctcttggccgtgccccccggagagagagcgaggaacatccagactctgcccggaatatttaagacaaaggatggggacattggagcggttgcgctggattacccagcaggaacttcaggatctccaatcctagacaagtgtgggagagtgataggactttatggcaatggggtcgtgatcaaaaatgggagttatgttagtgccatcacccaagggaggagggaggaagagactcctgttgagtgcttcgagccttcgatgctgaagaagaagcagctaactgtcttagacttacatcctggagctgggaaaaccaggagagttcttcctgaaatagtccgtgaagccataaaaacaagactccgtactgtgatcttagctccaaccagggttgtcgctgctgaaatggaggaggcccttagagggcttccagtgcgttatatgacaacagcagtcaatgtcacccactctggaacagaaatcgtcgacttaatgtgccatgccaccttcacttcacgtctactacagccaatcagagtccccaactataatctgtatattatggatgaggcccacttcacagatccctcaagtatagcagcaagaggatacatttcaacaagggttgagatgggcgaggcggctgccatcttcatgaccgccacgccaccaggaacccgtgacgcatttccggactccaactcaccaattatggacaccgaagtggaagtcccagagagagcctggagctcaggctttgattgggtgacggatcattctggaaaaacagtttggtttgttccaagcgtgaggaacggcaatgagatcgcagcttgtctgacaaaggctggaaaacgggtcatacagctcagcagaaagacttttgagacagagttccagaaaacaaaacatcaagagtgggactttgtcgtgacaactgacatttcagagatgggcgccaactttaaagctgaccgtgtcatagattccaggagatgcctaaagccggtcatacttgatggcgagagagtcattctggctggacccatgcctgtcacacatgccagcgctgcccagaggagggggcgcataggcaggaatcccaacaaacctggagatgagtatctgtatggaggtgggtgcgcagagactgacgaagaccatgcacactggcttgaagcaagaatgctccttgacaatatttacctccaagatggcctcatagcctcgctctatcgacctgaggccgacaaagtagcagccattgagggagagttcaagcttaggacggagcaaaggaagacctttgtggaactcatgaaaagaggagatcttcctgtttggctggcctatcaggttgcatctgccggaataacctacacagatagaagatggtgctttgatggcacgaccaacaacaccatactggaagacagtgtgccggcagaggtgtggaccagacacggagagaaaagagtgctcaaaccgaggtggatggacgccagagtttgttcagatcatgcggccctgaagtcattcaaggagtttgccgctgggaaaagaggagcggcttttggagtgatggaagccttgggaacactgccaggacacatgacagagagattccaggaagccattgacaacctcgctgtgctcatgcgggcagagactggaagcaggccttacaaagccgcggcggcccaattgccggagaccctagagaccattatgcttttggggttgctgggaacagtctcgctgggaatctttttcgtcttgatgaggaacaagggcatagggaagatgggctttggaatggtgacccttggggccagtgcatggctcatgtggctctcggaaattgagccagccagaattgcatgtgtcctcattgttgtgttcctattgctggtggtgctcatacctgagccagaaaagcaaagatctccccaggacaaccaaatggcaatcatcatcatggtagcagtaggtcttctgggcttgattaccgccaatgaactcggatggttggagagaacaaagagtgacctaagccatctaatgggaaggagagaggagggagcaaccataggattctcaatggacattgacctgcggccagcctcagcttgggccatctatgctgccttgacaactttcattaccccagccgtccaacatgcagtgaccacttcatacaacaactactccttaatggcgatggccacgcaagctggagtgttgtttggtatgggcaaagggatgccattctacgcatgggactttggagtcccgctgctaatgataggttgctactcacaattaacacccctgaccctaatagtggccatcattttgctcgtggcgcactacatgtacttgatcccagggctgcaggcagcagctgcgcgtgctgcccagaagagaacggcagctggcatcatgaagaaccctgttgtggatggaatagtggtgactgacattgacacaatgacaattgacccccaagtggagaaaaagatgggacaggtgctactcatagcagtagccgtctccagcgccatactgtcgcggaccgcctgggggtggggggaggctggggccctgatcacagccgcaacttccactttgtgggaaggctctccgaacaagtactggaactcctctacagccacttcactgtgtaacatttttaggggaagttacttggctggagcttctctaatctacacagtaacaagaaacgctggcttggtcaagagacgtgggggtggaacaggagagaccctgggagagaaatggaaggcccgcttgaaccagatgtcggccctggagttctactcctacaaaaagtcaggcatcactgaggtgtgcagagaagaggcccgccgcgccctcaaggacggtgtggcaacgggaggccatgctgtgtcccgaggaagtgcaaagctgagatggttggtggagcggggatacctgcagccctatggaaaggtcattgatcttggatgtggcagagggggctggagttactacgccgccaccatccgcaaagttcaagaagtgaaaggatacacaaaaggaggccctggtcatgaagaacccgtgttggtgcaaagctatgggtggaacatagtccgtcttaagagtggggtggacgtctttcatatggcggctgagccgtgtgacacgttgctgtgtgacataggcgagtcatcatctagtcctgaagtggaagaagcacggacgctcagagtcctctccatggtgggggattggcttgaaagaagaccaggagccttttgtataaaagtgttgtgcccatacaccagcactatgatggaaaccctggagcgactgcagcgtaggtatgggggaggactggtcagagtgccactctcccgcaactctacacatgagatgtactgggtctctggagcgaaaagcaacaccataaaaagtgtgtccaccacgagccagctcctcttggggcgcatggacgggcctaggaggccagtgaaatatgaggaggatgtgaatctcggctctggcacgcgggctgtggtaagctgcgctgaagctcccaacatgaagatcattggtaaccgcattgaaaggatccgcagtgagcacgcggaaacgtggttctttgacgagaaccacccatataggacatgggcttaccatggaagctatgaggcccccacacaagggtcagcgtcctctctaataaacggggttgtcaggctcctgtcaaaaccctgggatgtggtgactggagtcacaggaatagccatgaccgacaccacaccgtatggtcagcaaagagttttcaaggaaaaagtggacactagggtgccagacccccaagaaggcactcgtcaggttatgagcatggtctcttcctggttgtggaaagagctaggcaaacacaaacggccacgagtctgtaccaaagaagagttcatcaacaaggttcgtagcaatgcagcattaggggcaatatttgaagaggaaaaagagtggaagactgcagtggaagctgtgaacgatccaaggttctgggctctagtggacaaggaaagagagcaccacctgagaggagagtgccagagttgtgtgtacaacatgatgggaaaaagagaaaagaaacaaggggaatttggaaaggccaagggcagccgcgccatctggtatatgtggctaggggctagatttctagagttcgaagcccttggattcttgaacgaggatcactggatggggagagagaactcaggaggtggtgttgaagggctgggattacaaagactcggatatgtcctagaagagatgagttgcataccaggaggaaggatgtatgcagatgacactgctggctgggacacccgcatcagcaggtttgatctggagaatgaagctctaatcaccaaccaaatggagaaagggcacagggccttggcattggccataatcaagtacacataccaaaacaaagtggtaaaggtccttagaccagctgaaaaagggaaaacagttatggacattatttcaagacaagaccaaagggggagcggacaagttgtcacttacgctcttaacacatttaccaacctagtggtgcaactcattcggaatatggaggctgaggaagttctagagatgcaagacttgtggctgctgcggaggtcagagaaagtgaccaactggttgcagagcaacggatgggataggctcaaacgaatggcagtcagtggagatgattgcgttgtgaagccaattgatgataggtttgcacatgccctcaggttcttgaatgatatgggaaaagttaggaaggacacacaagagtggaaaccctcaactggatgggacaactgggaagaagttccgttttgctcccaccacttcaacaagctccatctcaaggacgggaggtccattgtggttccctgccgccaccaagatgaactgattggccgggcccgcgtctctccaggggcgggatggagcatccgggagactgcttgcctagcaaaatcatatgcgcaaatgtggcagctcctttatttccacagaagggacctccgactgatggccaatgccatttgttcatctgtgccagttgactgggttccaactgggagaactacctggtcaatccatggaaagggagaatggatgaccactgaagacatgcttgtggtgtggaacagagtgtggattgaggagaacgaccacatggaagacaagaccccagttacgaaatggacagacattccctatttgggaaaaagggaagacttgtggtgtggatctctcatagggcacagaccgcgcaccacctgggctgagaacattaaaaacacagtcaacatggtgcgcaggatcataggtgatgaagaaaagtacatggactacctatccacccaagttcgctacttgggtgaagaagggtctacacctggagtgctgtaa

SEQ ID NO: 72 - DNA, 10272 bp, Zika virus
  Strain 103344 polyprotein gene, complete cds
atgaaaaacccaaaaaagaaatccggaggattccggattgtcaatatgctaaaacgcggagtagcccgtgtgagcccctttgggggcttgaagaggctgccagccggacttctgctgggtcatgggcccatcaggatggtcttggcgattctagcctttttgagattcacggcaatcaagccatcactgggtctcatcaatagatggggttcagtggggaaaaaagaggctatggaaataataaagaagttcaagaaagatctggctgccatgctgagaataatcaatgctaggaaggagaagaagagacgaggcgcagatactagtgtcggaattgttggcctcctgctgaccacagctatggcagcggaggtcactagacgtgggagtgcatactatatgtacttggacagaaacgatgctggggaggccatatcttttccaaccacattggggatgaataagtgttatatacagatcatggatcttggacacatgtgtgatgccaccatgagctatgaatgccctatgctggatgagggggtggaaccagatgacgtcgattgttggtgcaacacgacgtcaacttgggttgtgtacggaacctgccatcacaaaaaaggtgaagcacggagatctagaagagctgtgacgctcccctcccattccactaggaagctgcaaacgcggtcgcaaacctggttggaatcaagagaatacacaaagcacttgattagagtcgaaaattggatattcaggaaccctggcttcgcgttagcagcagctgccatcgcttggcttttgggaagctcaacgagccaaaaagtcatatacttggtcatgatactgctgattgccccggcatacagcatcaggtgcataggagtcagcaatagggactttgtggaaggtatgtcaggtgggacttgggttgatgttgtcttggaacatggaggttgtgtcaccgtaatggcacaggacaaaccgactgtcgacatagagctggttacaacaacagtcagcaacatggcggagataagatcctactgctatgaggcatcaatatcagacatggcttcggacagccgctgcccaacacaaggtgaagcctaccttgacaagcaatcagacactcaatatgtctgcaaaagaacgttagtggacagaggctggggaaatggatgtggactttttggcaaagggagcctggtgacatgcgctaagtttgcatgctccaagaaaatgaccgggaagagcatccagccagagaatctggagtaccggataatgctgtcagttcatggctcccagcacagtgggatgatcgttaatgacacaggacatgaaactgatgagaatagagcgaaggttgagataacgcccaattcaccaagagccgaagccaccctggggggttttggaagcctaggacttgattgtgaaccgaggacaggccttgacttttcagatttgtattacttgactatgaataacaagcactggttggttcacaaggagtggttccacgacattccattaccttggcacgctggggcagacaccggaactccacactggaacaacaaagaagcactggtggagttcaaggacgcacatgccaaaaggcaaactgtcgtggttctagggagtcaagaaggagcagttcacacggcccttgctggagctctggaggctgagatggatggtgcaaagggaaggctgtcctctggccacttgaaatgtcgcctgaaaatggataaacttagattgaagggcgtgtcatactccttgtgtaccgcagcgttcacattcaccaagatcccggctgaaacactgcacgggacagtcacagtggaggtacagtacgcagggacagatggaccttgcaaggttccagctcagatggcggtggacatgcaaactctgaccccagttgggaggttgataaccgctaaccccgtaatcactgaaagcactgagaactctaagatgatgctggaacttgatccaccatttggggactcttacattgtcataggagtcggggagaagaagatcacccaccactggcacaggagtggcagcaccattggaaaagcatttgaagccactgtgagaggtgccaagagaatggcagtcttgggagacacagcctgggactttggatcagttggaggcgctctcaactcattgggcaagggcatccatcaaatttttggagctgctttcaaatcattgtttggaggaatgtcctggttctcacaaattctcattggaacgttgctgatgtggttgggtctgaacacaaagaatggatctatttcccttatgtgcttggccttagggggagtgttgatcttcttatccacagccgtctctgctgatgtggggtgctcggtggacttctcaaagaaggagacgagatgcggtacaggggtgttcgtctataacgacgttgaagcctggagggacaggtacaagtaccatcctgactccccccgtagattggcagcagcagtcaagcaagcctgggaagatggtatctgcgggatctcctctgtttcaagaatggaaaacatcatgtggagatcagtagaaggggagctcaacgcaatcctggaagagaatggagttcaactgacggtcgttgtgggatctgtaaaaaaccccatgtggagagctccacagagattgcccgtgcctgtgaacgagctgccccacggctggaaggcttgggggaaatcgtacttcgtcagagcagcaaagacaaataacagctttgtcgtggatggtgacacactgaaggaatgcccactcaaacatagagcatggaacagctttcttgtggaggatcatgggttcggggtatttcacactagtgtctggctcaaggttagagaagattattcattagagtgtgatccagccgttattggaacagctgttaagggaaaggaggctgtacacagtgatctaggctactggattgagagtgagaagaatgacacatggaggctgaagagggcccatctgatcgagatgaaaacatgtgaatggccaaagtcccacacattgtggacagatggaatagaagagagtgatctgatcatacccaagtctttagctgggccactcagccatcacaataccagagagggctacaggacccaaatgaaagggccatggcacagtgaagagcttgaaattcggtttgaggaatgcccaggcactaaggtccacgtggaggaaacatgtggaacaagaggaccatctctgagatcaaccactgcaagcggaagggtgatcgaggaatggtgctgcagggagtgcacaatgcccccactgtcgttccgggctaaagatggctgttggtatggaatggagataaggcccaggaaagaaccagaaagcaacttagtaaggtcaatggtgactgcaggatcaactgatcacatggatcacttctcccttggagtgcttgtgattctgctcatggtgcaggaagggctaaagaagagaatgaccacaaagatcatcataagcacatcaatggcagtgctggtagctatgatcctgggaggattttcaatgagtgacctggctaagcttgcaattttgatgggtgccaccttcgcggaaatgaacactggaggagatgtagctcatctggcgctgatagcggcattcaaagtcagaccagcgttgctggtatctttcatcttcagagctaattggacaccccgtgaaagcatgctactggccttggcctcgtgtcttttgcaaactgcgatctccgccttggaaggcgacctgatggttctcatcaatggttttgctttggcctggttggcaatacgagcgatggttgttccacgcactgataacatcaccttggcaatcctggctgctctgacaccactggcccggggcacactgcttgtggcgtggagagcaggccttgctacttgcggggggtttatgctcctctctctgaagggaaaaggcagtgtgaagaagaacttaccatttgtcatggccctgggactaaccgctgtgaggctggtcgaccccatcaacgtggtgggactgctgttgctcacaaggagtgggaagcggagctggccccctagcgaagtactcacagctgttggcctgatatgcgcattggctggagggttcgccaaggcagatatagagatggctgggcccatggccgcggtcggtctgctaattgtcagttacgtggtctcaggaaagagtgtggacatgtacattgaaagagcaggtgacatcacatgggaaaaagatgcggaagtcactggaaacagtccccggctcgatgtggcgctagatgagagtggtgatttctccctggtggaggatgacggtccccccatgagagagatcatactcaaggtggtcctgatgaccatctgtggcatgaacccaatagccataccctttgcagctggagcgtggtacgtatacgtgaagactggaaaaaggagtggtgctctatgggatgtgcctgctcccaaggaagtaaaaaagggggagaccacagatggagtgtacagagtaatgactcgtagactgctaggttcaacacaagttggagtgggagttatgcaagagggggtctttcacactatgtggcacgtcacaaaaggatccgcactgagaagcggtgaagggagacttgatccatactggggagatgtcaagcaggatctggtgtcatactgtggtccatggaagctagatgccgcctgggacgggcacagcgaggtgcagctcttggccgtgccccccggagagagagcgaggaacatccagactctgcccggaatatttaagacaaaggatggggacattggagcggttgcgctggattacccagcaggaacttcaggatctccaatcctagacaagtgtgggagagtgataggactttatggcaatggggtcgtgatcaaaaatgggagttatgttagtgccatcacccaagggaggagggaggaagagactcctgttgagtgcttcgagccttcgatgctgaagaagaagcagctaactgtcttagacttacatcctggagctgggaaaaccaggagagttcttcctgaaatagtccgtgaagccataaaaacaagactccgtactgtgatcttagctccaaccagggttgtcgctgctgaaatggaggaggcccttagagggcttccagtgcgttatatgacaacagcagtcaatgtcacccactctggaacagaaatcgtcgacttaatgtgccatgccaccttcacttcacgtctactacagccaatcagagtccccaactataatctgtatattatggatgaggcccacttcacagatccctcaagtatagcagcaagaggatacatttcaacaagggttgagatgggcgaggcggctgccatcttcatgaccgccacgccaccaggaacccgtgacgcatttccggactccaactcaccaattatggacaccgaagtggaagtcccagagagagcctggagctcaggctttgattgggtgacggatcattctggaaaaacagtttggtttgttccaagcgtgaggaacggcaatgagatcgcagcttgtctgacaaaggctggaaaacgggtcatacagctcagcagaaagacttttgagacagagttccagaaaacaaaacatcaagagtgggactttgtcgtgacaactgacatttcagagatgggcgccaactttaaagctgaccgtgtcatagattccaggagatgcctaaagccggtcatacttgatggcgagagagtcattctggctggacccatgcctgtcacacatgccagcgctgcccagaggagggggcgcataggcaggaatcccaacaaacctggagatgagtatctgtatggaggtgggtgcgcagagactgacgaagaccatgcacactggcttgaagcaagaatgctccttgacaatatttacctccaagatggcctcatagcctcgctctatcgacctgaggccgacaaagtagcagccattgagggagagttcaagcttaggacggagcaaaggaagacctttgtggaactcatgaaaagaggagatcttcctgtttggctggcctatcaggttgcatctgccggaataacctacacagatagaagatggtgctttgatggcacgaccaacaacaccatactggaagacagtgtgccggcagaggtgtggaccagacacggagagaaaagagtgctcaaaccgaggtggatggacgccagagtttgttcagatcatgcggccctgaagtcattcaaggagtttgccgctgggaaaagaggagcggcttttggagtgatggaagccttgggaacactgccaggacacatgacagagagattccaggaagccattgacaacctcgctgtgctcatgcgggcagagactggaagcaggccttacaaagccgcggcggcccaattgccggagaccctagagaccattatgcttttggggttgctgggaacagtctcgctgggaatctttttcgtcttgatgaggaacaagggcatagggaagatgggctttggaatggtgacccttggggccagtgcatggctcatgtggctctcggaaattgagccagccagaattgcatgtgtcctcattgttgtgttcctattgctggtggtgctcatacctgagccagaaaagcaaagatctccccaggacaaccaaatggcaatcatcatcatggtagcagtaggtcttctgggcttgattaccgccaatgaactcggatggttggagagaacaaagagtgacctaagccatctaatgggaaggagagaggagggagcaaccataggattctcaatggacattgacctgcggccagcctcagcttgggccatctatgctgccttgacaactttcattaccccagccgtccaacatgcagtgaccacttcatacaacaactactccttaatggcgatggccacgcaagctggagtgttgtttggtatgggcaaagggatgccattctacgcatgggactttggagtcccgctgctaatgataggttgctactcacaattaacacccctgaccctaatagtggccatcattttgctcgtggcgcactacatgtacttgatcccagggctgcaggcagcagctgcgcgtgctgcccagaagagaacggcagctggcatcatgaagaaccctgttgtggatggaatagtggtgactgacattgacacaatgacaattgacccccaagtggagaaaaagatgggacaggtgctactcatagcagtagccgtctccagcgccatactgtcgcggaccgcctgggggtggggggaggctggggccctgatcacagccgcaacttccactttgtgggaaggctctccgaacaagtactggaactcctctacagccacttcactgtgtaacatttttaggggaagttatttggctggagcttctctaatctacacagtaacaagaaacgctggcttggtcaagagacgtgggggtggaacaggagagaccctgggagagaaatggaaggcccgcttgaaccagatgtcggccctggagttctactcctacaaaaagtcaggcatcactgaggtgtgcagagaagaggcccgccgcgccctcaaggacggtgtggcaacgggaggccatgctgtgtcccgaggaagtgcaaagctgagatggttggtggagcggggatacctgcagccctatggaaaggtcattgatcttggatgtggcagagggggctggagttactacgccgccaccatccgcaaagttcaagaagtgaaaggatacacaaaaggaggccctggtcatgaagaacccgtgttggtgcaaagctatgggtggaacatagtccgtcttaagagtggggtggacgtctttcatatggcggctgagccgtgtgacacgttgctgtgtgacataggcgagtcatcatctagtcctgaagtggaagaagcacggacgctcagagtcctctccatggtgggggattggcttgaaagaagaccaggagccttttgtataaaagtgttgtgcccatacaccagcactatgatggaaaccctggagcgactgcagcgtaggtatgggggaggactggtcagagtgccactctcccgcaactctacacatgagatgtactgggtctctggagcgaaaagcaacaccataaaaagtgtgtccaccacgagccagctcctcttggggcgcatggacgggcctaggaggccagtgaaatatgaggaggatgtgaatctcggctctggcacgcgggctgtggtaagctgcgctgaagctcccaacatgaagatcattggtaaccgcattgaaaggatccgcagtgagcacgcggaaacgtggttctttgacgagaaccacccatataggacatgggcttaccatggaagctatgaggcccccacacaagggtcagcgtcctctctaataaacggggttgtcaggctcctgtcaaaaccctgggatgtggtgactggagtcacaggaatagccatgaccgacaccacaccgtatggtcagcaaagagttttcaaggaaaaagtggacactagggtgccagacccccaagaaggcactcgtcaggttatgagcatggtctcttcctggttgtggaaagagctaggcaaacacaaacggccacgagtctgtaccaaagaagagttcatcaacaaggttcgtagcaatgcagcattaggggcaatatttgaagaggaaaaagagtggaagactgcagtggaagctgtgaacgatccaaggttctgggctctagtggacaaggaaagagagcaccacctgagaggagagtgccagagttgtgtgtacaacatgatgggaaaaagagaaaagaaacaaggggaatttggaaaggccaagggcagccgcgccatctggtatatgtggctaggggctagatttctagagttcgaagcccttggattcttgaacgaggatcactggatggggagagagaactcaggaggtggtgttgaagggctgggattacaaagactcggatatgtcctagaagagatgagttgcataccaggaggaaggatgtatgcagatgacactgctggctgggacacccgcatcagcaggtttgatctggagaatgaagctctaatcaccaaccaaatggagaaagggcacagggccttggcattggccataatcaagtacacataccaaaacaaagtggtaaaggtccttagaccagctgaaaaagggaaaacagttatggacattatttcaagacaagaccaaagggggagcggacaagttgtcacttacgctcttaacacatttaccaacctagtggtgcaactcattcggaatatggaggctgaggaagttctagagatgcaagacttgtggctgctgcggaggtcagagaaagtgaccaactggttgcagagcaacggatgggataggctcaaacgaatggcagtcagtggagatgattgcgttgtgaagccaattgatgataggtttgcacatgccctcaggttcttgaatgatatgggaaaagttaggaaggacacacaagagtggaaaccctcaactggatgggacaactgggaagaagttccgttttgctcccaccacttcaacaagctccatctcaaggacgggaggtccattgtggttccctgccgccaccaagatgaactgattggccgggcccgcgtctctccaggggcgggatggagcatccgggagactgcttgcctagcaaaatcatatgcgcaaatgtggcagctcctttatttccacagaagggacctccgactgatggccaatgccatttgttcatctgtgccagttgactgggttccaactgggagaactacctggtcaatccatggaaagggagaatggatgaccactgaagacatgcttgtggtgtggaacagagtgtggattgaggagaacgaccacatggaagacaagaccccagttacgaaatggacagacattccctatttgggaaaaagggaagacttgtggtgtggatctctcatagggcacagaccgcgcaccacctgggctgagaacattaaaaacacagtcaacatggtgcgcaggatcataggtgatgaagaaaagtacatggactacctatccacccaagttcgctacttgggtgaagaagggtctacacctggagtgctgtaa

SEQ ID NO: 73 - DNA, 10272 bp, Zika virus
  Strain ArD158084 polyprotein gene, complete cds
atgaaaaacccaaagaagaaatccggaggattccggattgtcaatatgctaaaacgcggagtagcccgtgtaaaccccttgggaggtttgaagaggttgccagccggacttctgctgggtcatggacccatcagaatggttttggcgatactagcctttttgagatttacagcaatcaagccatcactgggccttatcaacagatggggttccgtggggaaaaaagaggctatggaaataataaagaagttcaagaaagatcttgctgccatgttgagaataatcaatgctaggaaagagaggaagagacgtggcgcagacaccagcatcggaatcattggcctcctgctgactacagccatggcagcagagatcactagacgcgggagtgcatactacatgtacttggataggagcgatgccgggaaggccatttcgtttgctaccacattgggagtgaacaagtgccacgtacagatcatggacctcgggcacatgtgtgacgccaccatgagttatgagtgccctatgctggatgagggagtggaaccagatgatgtcgattgctggtgcaacacgacatcaacttgggttgtgtacggaacctgtcatcacaaaaaaggtgaggcacggcgatctagaagagccgtgacgctcccttctcactctacaaggaagttgcaaacgcggtcgcagacctggttagaatcaagagaatacacgaagcacttgatcaaggttgaaaactggatattcaggaaccccgggtttgcgctagtggccgttgccattgcctggcttttgggaagctcgacgagccaaaaagtcatatacttggtcatgatactgctgattgccccggcatacagtatcaggtgcattggagtcagcaatagagacttcgtggagggcatgtcaggtgggacctgggttgatgttgtcttggaacatggaggctgcgttaccgtgatggcacaggacaagccaacagttgacatagagttggtcacgacgacggttagtaacatggccgaggtaagatcctattgctacgaggcatcgatatcggacatggcttcggacagtcgttgcccaacacaaggtgaagcctaccttgacaagcaatcagacactcaatatgtctgcaaaagaacattagtggacagaggttggggaaatggttgtggactttttggcaaagggagcttggtgacatgtgccaagttcacgtgttctaagaagatgaccgggaagagcattcaaccggaaaatctggagtatcggataatgctatcagtgcatggctcccagcatagcgggatgattgtcaatgatataggacatgaaactgacgaaaacagagcgaaagtcgaggttacgcctaattcaccaagagcggaagcaaccttgggaggctttggaagcttaggacttgactgtgaaccaaggacaggccttgacttttcagatctgtattacctgaccatgaacaataagcattggttggtgcacaaagagtggtttcatgacatcccattgccttggcatgctggggcagacaccggaactccacactggaacaacaaagaggcattggtagaattcaaggatgcccacgccaagaggcaaaccgtcgtcgttctggggagccaggaaggagccgttcacacggctctcgctggagctctagaggctgagatggatggtgcaaagggaaggctgttctctggccatttgaaatgccgcctaaaaatggacaagcttagattgaagggcgtgtcatattccttgtgcactgcggcattcacattcaccaaggtcccagctgaaacactgcatggaacagtcacagtggaggtgcagtatgcagggacagatggaccctgcaaggtcccagcccagatggcggtggacatgcagaccctgaccccagttggaaggctgataaccgccaaccccgtgattactgaaagcactgagaactcaaagatgatgttggagcttgacccaccatttggggattcttacattgtcataggagttggggacaagaaaatcacccaccactggcataggagtggtagcaccatcggaaaggcatttgaagccactgtgagaggcgccaagagaatggcagtcctgggggatacagcctgggacttcggatcagtcgggggtgtgttcaactcactgggtaagggcattcaccagatttttggagcagccttcaaatcactgtttggaggaatgtcctggttctcacagatcctcataggcacgctgctagtgtggttaggtttgaacacaaagaatggatctatctccctcacatgcttggccctggggggagtgatgatcttcctctccacggctgtttctgctgacgtggggtgctcagtggacttctcaaaaagagaaacgagatgtggcacgggggtattcatctataatgatgttgaagcctggagggaccggtacaagtaccatcctgactccccccgcagattggcagcagcagtcaagcaggcctgggaagaggggatctgtgggatctcatccgtttcaagaatggaaaacatcatgtggaaatcagtagaaggggagctcaatgctatcctagaggagaatggagttcaactgacagttgttgtgggatctgtaaaaaaccccatgtggagaggtccacaaagattgccagtgcctgtgaatgggctgccccatggctggaaagcctgggggaaatcgtattttgttagggcggcaaagaccaacaacagttttgttgtcgacggtgacacactgaaggaatgtccgcttaagcacagagcatggaatagttttcttgtggaggatcacgggtttggagtcttccacaccagtgtttggcttaaggtcagagaagattactcattagaatgtgacccagccgtcataggaacagctgttaagggaagggaggccgcgcacagtgatctgggctattggattgaaagtgaaaagaatgacacatggaggctgaagagggcccacctgattgagatgaaaacatgtgaatggccaaagtctcacacattgtggacagatggagtagaagaaagtgatcttatcatacccaagtctttagctggtccactcagccaccacaacaccagagagggttacagaacccaagtgaaagggccatggcacagtgaagagcttgaaatccggtttgaggaatgtccaggcaccaaggttcacgtggaggagacatgcggaactagaggaccatctctgagatcaactactgcaagtggaagggtcattgaggaatggtgctgtagggaatgcacaatgcccccactatcgtttcgagcaaaagacggctgctggtatggaatggagataaggcccaggaaagaaccagagagcaacttagtgaggtcaatggtgacagcggggtcaaccgatcatatggaccacttctctcttggagtgcttgtgattctactcatggtgcaggaggggttgaagaagagaatgaccacaaagatcatcatgagcacatcaatggcagtgctggtagtcatgatcttgggaggattttcaatgagtgacctggccaagcttgtgatcctgatgggtgctactttcgcagaaatgaacactggaggagatgtagctcacttggcattggtagcggcatttaaagtcagaccagccttgctggtctccttcattctcagagccaattggacaccccgtgagagcatgctgctagccctggcttcgtgtcttctgcaaactgcgatctctgctcttgaaggtgacttgatggtcctcgttaatggatttgctttggcctggttggcaattcgagcaatggccgtgccacgcactgacaacatcgctctagcaatcttggctgctctaacaccactagctcgaggcacactgctcgtggcatggagagcgggcctggctacttgtggagggttcatgctcctctccctgaaagggaaaggtagtgtgaagaagaacctgccatttgtcatggccctgggattgacagctgtgagggtagtagaccctattaatgtggtaggactactgttactcacaaggagtgggaagcggagctggccccctagtgaagttctcacagccgttggcctgatatgtgcactggccggagggtttgccaaggcagacattgagatggctggacccatggctgcagtaggcttgctaattgtcagctatgtggtctcgggaaagagtgtggacatgtacattgaaagagcaggtgacatcacatgggaaaaggacgcggaagtcactggaaacagtcctcggcttgacgtggcactggatgagagtggtgatttctccttggtagaggaagatggtccacccatgagagagatcatactcaaggtggtcctgatggccatctgtggcatgaacccaatagctataccttttgctgcaggagcgtggtatgtgtatgtgaagactgggaaaaggagtggcgccctctgggacgtgcctgctcccaaagaagtgaagaaaggagagaccacagatggagtgtacagagtgatgactcgcagactgctaggttcaacacaggttggagtgggagtcatgcaagagggagtcttccacaccatgtggcacgttacaaaaggagccgcactgaggagcggtgagggaagacttgatccatactggggggatgtcaagcaggacttggtgtcatactgtgggccttggaagttggatgcagcttgggatggacttagcgaggtacagcttttggccgtacctcccggagagagggccagaaacattcagaccctgcctggaatattcaagacaaaggacggggacatcggagcagttgctctggactaccctgcagggacctcaggatctccgatcctagacaaatgtggaagagtgataggactctatggcaatggggttgtgatcaagaatggaagctatgttagtgctataacccagggaaagagggaggaggagactccggttgaatgtttcgaaccctcgatgctgaagaagaagcagctaactgtcctggatctgcatccaggagccggaaaaaccaggagagttcttcctgaaatagtccgtgaagccataaaaaagagactccggacagtgatcttggcaccaactagggttgtcgctgctgagatggaggaagccttgagaggacttccggtgcgttacatgacaacagcagtcaacgtcacccattctgggacagaaatcgttgatttgatgtgccatgccactttcacttcacgcttactacaacccatcagagtccctaattacaatctcaacatcatggatgaagcccacttcacagacccctcaagtatagctgcaagaggatacatatcaacaagggttgaaatgggcgaggcggctgccatttttatgactgccacaccaccaggaacccgtgatgcgtttcctgactctaactcaccaatcatggacacagaagtggaagtcccagagagagcctggagctcaggctttgattgggtgacagaccattctgggaaaacagtttggttcgttccaagcgtgagaaacggaaatgaaatcgcagcctgtctgacaaaggctggaaagcgggtcatacagctcagcaggaagacttttgagacagaatttcagaaaacaaaaaatcaagagtgggactttgtcataacaactgacatctcagagatgggcgccaacttcaaggctgaccgggtcatagactctaggagatgcctaaaaccagtcatacttgatggtgagagagtcatcttggctgggcccatgcctgtcacgcatgctagtgctgctcagaggagaggacgtataggcaggaaccctaacaaacctggagatgagtacatgtatggaggtgggtgtgcagagactgatgaaggccatgcacactggcttgaagcaagaatgcttcttgacaacatctacctccaggatggcctcatagcctcgctctatcggcctgaggccgataaggtagccgccattgagggagagtttaagctgaggacagagcaaaggaagaccttcgtggaactcatgaagagaggagaccttcccgtctggctagcctatcaggttgcatctgccggaataacttacacagacagaagatggtgctttgatggcacaaccaacaacaccataatggaagacagtgtaccagcagaggtttggacaaagtatggagagaagagagtgctcaaaccgagatggatggatgctagggtctgttcagaccatgcggccctgaagtcgttcaaagaattcgccgctggaaaaagaggagcggctttgggagtaatggaggccctgggaacactgccaggacacatgacagagaggtttcaggaagccattgacaacctcgccgtgctcatgcgagcagagactggaagcaggccttataaggcagcggcagcccaactgccggagaccctagagaccattatgctcttaggtttgctgggaacagtttcactggggatcttctttgtcttgatgcggaataagggcatcgggaagatgggctttggaatggtaacccttggggccagtgcatggctcatgtggctttcggaaattgaaccagccagaattgcatgtgtcctcattgttgtgtttttattactggtggtgctcatacccgagccagagaagcaaagatctccccaagataaccagatggcaattatcatcatggtggcagtgggccttctaggtttgataactgcaaacgaacttggatggctggaaagaacaaaaaatgacatagctcatctaatgggaaggagagaagaaggagcaaccatgggattctcaatggacattgatctgcggccagcctccgcctgggctatctatgccgcattgacaactctcatcaccccagctgtccaacatgcggtaaccacttcatacaacaactactccttaatggcgatggccacacaagctggagtgctgtttggcatgggcaaagggatgccattttatgcatgggactttggagtcccgctgctaatgatgggttgctattcacaattaacacccctgactctgatagtagctatcattctgcttgtggcgcactacatgtacttgatcccaggcctacaagcggcagcagcgcgtgctgcccagaaaaggacagcagctggcatcatgaagaatcccgttgtggatggaatagtggtaactgacattgacacaatgacaatagacccccaggtggagaagaagatgggacaagtgttactcatagcagtagccatctccagtgctgtgctgctgcggaccgcctggggatggggggaggctggagctctgatcacagcagcgacctccaccttgtgggaaggctctccaaacaaatactggaactcctctacagccacctcactgtgcaacatcttcagaggaagctatctggcaggagcttcccttatctatacagtgacgagaaacgctggcctggttaagagacgtggaggtgggacgggagagactctgggagagaagtggaaagctcgtctgaatcagatgtcggccctggagttctactcttataaaaagtcaggtatcactgaagtgtgtagagaggaggctcgccgtgccctcaaggatggagtggccacaggaggacatgccgtatcccggggaagtgcaaagctcagatggttggtggagagaggatatctgcagccccatgggaaggttgttgacctcggatgtggcagagggggctggagctattatgccgccaccatccgcaaagtgcaggaggtgagaggatacacaaagggaggtcccggtcatgaagaacccatgctggtgcaaagctatgggtggaacatagttcgtctcaagagtggagtggacgtcttccacatggcggctgagccgtgtgacactctgctgtgtgacataggtgagtcatcatctagtcctgaagtggaagagacacgaacactcagagtgctctctatggtgggggactggcttgaaaaaagaccaggggccttctgtataaaggtgctgtgcccatacaccagcactatgatggaaaccatggagcgactgcaacgtaggcatgggggaggattagtcagagtgccattgtctcgcaactccacacatgagatgtactgggtctctggggcaaaaagcaacatcataaaaagtgtgtccaccacaagtcagctcctcctgggacgcatggatggccccaggaggccagtgaaatatgaggaggatgtgaacctcggctcgggtacacgagctgtggcaagctgtgctgaggctcctaacatgaaaatcatcggcaggcgcattgagagaatccgcaatgaacatgcagaaacatggtttcttgatgaaaaccacccatacaggacatgggcctaccatgggagctacgaagcccccacgcaaggatcagcgtcttccctcgtgaacggggttgttagactcctgtcaaagccttgggacgtggtgactggagttacaggaatagccatgactgacaccacaccatacggccaacaaagagtcttcaaagaaaaagtggacaccagggtgccagatccccaagaaggcactcgccaggtaatgaacatggtctcttcctggctgtggaaggagctggggaaacgcaagcggccacgcgtctgcaccaaagaagagtttatcaacaaggtgcgcagcaatgcagcactgggagcaatatttgaagaggaaaaagaatggaagacggctgtggaagctgtgaatgatccaaggttttgggccctagtggatagggagagagaacaccacctgagaggagagtgtcacagctgtgtgtacaacatgatgggaaaaagagaaaagaagcaaggagagttcgggaaagcaaaaggtagccgcgccatctggtacatgtggttgggagccagattcttggagtttgaagcccttggattcttgaacgaggaccattggatgggaagagagaactctggaggcggagttgaaggactgggactgcagagactgggctatgtccttgaggagatgagccaggcaccaggagggaagatgtacgcagatgacactgctggctgggacacccgcattagtaagtttgatctggagaatgaagctttgattaccaaccaaatggaggaagggcacagaactctggcgttggccgtgattaaatacacataccaaaacaaagtggtgaaggtcctcagaccagctgaaggaggaaaaacagttatggacatcatttcaagacaagaccagagagggagtggacaagttgtcacttatgctctcaacacattcaccaacttggtggtgcagcttatccggaacatggaagctgaggaagtgttagagatgcaagacttatggctgttgaggaagccagagaaagtgaccagatggttgcagagcaatggatgggatggactcaaacgaatggcggtcagtggagatgactgcgttgtgaagccaatcgatgataggtttgcacatgccctcaggttcttgaatgacatgggaaaagttaggaaagacacacaggagtggaaaccctcgactggatggagcaattgggaagaagtcccgttctgctcccaccacttcaacaagctgtacctcaaggatgggagatccattgtggtcccttgccgccaccaagatgaactgattggccgagctcgcgtttcaccaggggcaggatggagcatccgggagactgcctgtcttgcaaaatcatatgcgcagatgtggcagctcctttatttccacagaagagaccttcgactgatggctaatgccatttgctcggctgtaccagttgactgggtaccaactgggagaaccacctggtcaatccatggaaagggagaatggatgaccactgaggacatgctcatggtgtggaatagagtgtggattgaggagaacgaccatatggaggacaagactcctgtaacaaaatggacagacattccctatctaggaaaaagggaggacttatggtgtggatcccttatagggcacagaccccgcaccacttgggctgaaaacatcaaagacacagtcaacatggtgcgcaggatcataggtgatgaagaaaagtacatggactatctatccacccaagtccgctacttgggtgaggaagggtccacacccggagtgttgtaa

SEQ ID NO: 74 - DNA, 10272 bp, Zika virus
  Strain ArD157995 polyprotein gene, complete cds
  misc_feature (2711)..(2711): n is a, c, g, or t
  misc_feature (8487)..(8487): n is a, c, g, or t
atgaaaaacccaaagaagaaatccggaagattccggattgtcaatatgctaaaacgcggagtagcccgtgtaaaccccttgggaggtttgaagaggttgccagccggacttctgctgggtcatggacccatcagaatggttttggcgatactagcctttttgagatttacagcaatcaagccatcactgggccttatcaacagatggggttccgtggggaaaaaagaggctatggaaataataaagaagttcaagaaagatcttgctgccatgttgagaataatcaatgctaggaaagagaggaagagacgtggcgcagacaccagcatcggaatcattggcctcctgctgactacagccatggcagcagagatcactagacgcgggagtgcatactacatgtacttggataggagcgatgccgggaaggccatttcgtttgctaccacattgggagtgaacaagtgccacgtacagatcatggacctcgggcacatgtgtgacgccaccatgagttatgagtgccctatgctggatgagggagtggaaccagatgatgtcgattgctggtgcaacacgacatcaacttgggttgtgtacggaacctgtcatcacaaaaaaggtgagacacggcgatctagaagatctgtgtcgctccgttatcactatacaaggaagttgcaaacgcggtcgcagacatggttagaatcaagagaatacaagaagcacttgatcatggtcgaaaactggatattcaggaaccccgggtttgccatagtgtccgttgccattacctggctgatgggaagcttgacgagccaaaaagtcatatacttggtcatgatagtgttgattgtcccggcatacagtatcagctgcattggagtcagcaatagagacttagtggagggcatgtcaggtgggacctgggttgatgttgtcttggaacatggagggtgcgttaccgagatggcacaggacaagccaacagttgacatagagttggtcacgatgacggttagtaacatggccgaggtaagatcctattgctacgaggcatcgttatccgacatggcttcggccagtcgttgcccaacacaaggcgaaccctccctcgacaagcaatcagacactcaatctgtatgcaaaagaacattaggagacagaggttggggaaatggttgtgggatttttggcaaagggagcttggtgacatgttccaagttcacgtgttgtaagaagatgcccgggaagagcattcaaccggaaaatctggagtatcggataatgctcccagtgcatggctcccagcatagcgggatgattgtgaatgacataggacatgaaactgacgaaaacagagcgaaagtcgaggtcacacccaattcaccaagagcagaagcaaccttgggaggttttggaagcttgggacttgactgtgaaccaaggacaggccttgacttctcagatctgtattatctgaccatgaacaacaagcattggttggtgcacaaggagtggtttcatgacatcccattaccttggcatgctggtgcagacactggaactccacactggaacaacaaagaggcattggtggagttcaaggacgcccacgccaagaggcaaactgttgtggttctggggagccaagagggagctgttcacacggccctcgctggagctctggaggctgagatggatggtgcaaagggaaggctattctctggccatttgaaatgccgcctaaaaatggacaagcttaggttgaagggtgtgtcatattccctgtgtactgcagcgttcacatttaccaaggtcccagctgaaacattgcatggaacagttacagtggaggtgcagtctgcagggacagatggaccctgcaaggtcccagcccagatggcggtggacatgcagaccctgaccccagttggaaggctgataaccgccaaccccgtgattactgaaagcactgagaactcaaagatgatgttggagcttgacccaccatttggggattcttacattgtcataggagttggggacaagaaaatcacccaccactggcataggagtggtagcaccatcggaaaggcatttgaagccactgtgagaggcgccaagagaatggcagtcctgggggatacagcctgggacttcggatcagtcgggggtgtgttcaactcactgggtaagggcattcaccagatttttggagcagccttcaaatcactgtttggaggaatgtcctggttctcacagatcctcataggcacgctgctagtgtggttaggtttgaacacaaagaatggatctatctccctcacatgcttggccctggggggagtgatgatcttcctctccacggctgtttctgctgacgtggggtgctcagtggacttctcaaaaaaggaaacgagatgtggcacgggggtattcatctataatgatgttgaagcctggagggaccggtacaagtaccatcctgactccccccgcagattggcagcagcagtcaagcaggcctgggaagaggggatctgtgggatctcatccgtttcaagaatggaaaacatcatgtggaaatcagtagaaggggagctcaatgctatcctagaggagaatggagttcaactgacagttgttgtgggatctgtaaaaaaccccatgtggagaggtccacaaagattgccagtgcctgtgaatgngctgccccatggctggaaagcctgggggaaatcgtattttgttagggcggcaaagaccaacaacagttttgttgtcgacggtgacacactgaaggaatgtccgcttaagcacagagcatggaatagttttcttgtggaggatcacgggtttggagtcttccacaccagtgtttggcttaaggtcagagaagattactcattagaatgtgacccagccgtcataggaacagctgttaagggaagggaggccgcgcacagtgatctgggctattggattgaaagtgaaaagaatgacacatggaggctgaagagggcccacctgattgagatgaaaacatgtgaatggccaaagtctcacacattgtggacagatggagtagaagaaagtgatcttatcatacccaagtctttagctggtccactcagccaccacaacaccagagagggttacagaacccaagtgaaagggccatggcacagtgaagagcttgaaatccggtttgaggaatgtccaggcaccaaggttcacgtggaggagacatgcggaactagaggaccatctctgagatcaactactgcaagtggaagggtcattgaggaatggtgctgtagggaatgcacaatgcccccactatcgtttcgagcaaaagacggctgctggtatggaatggagataaggcccaggaaagaaccagagagcaacttagtgaggtcaatggtgacagcggggtcaaccgatcatatggaccacttctctcttggagtgcttgtgattctactcatggtgcaggaggggttgaagaagagaatgaccacaaagatcatcatgagcacatcaatggcagtgctggtagtcatgatcttgggaggattttcaatgagtgacctggccaagcttgtgatcctgatgggtgctactttcgcagaaatgaacactggaggagatgtagctcacttggcattggtagcggcatttaaagtcagaccagccttgctggtctccttcattctcagagccaattggacaccccgtgagagcatgctgctagccctggcttcgtgtcttctgcaaactgcgatctctgctcttgaaggtgacttgatggtcctcgttaatggatttgctttggcctggttggcaattcgagcaatggccgtgccacgcactgacaacatcgctctagcaatcttggctgctctaacaccactagctcgaggcacactgctcgtggcatggagagcgggcctggctacttgtggagggttcatgctcctctccctgaaagggaaaggtagtgtgaagaagaacctgccatttgtcatggccctgggattgacagctgtgagggtagtagaccctattaatgtggtaggactactgttactcacaaggagtgggaagcggagctggccccctagtgaagttctcacagccgttggcctgatatgtgcactggccggagggtttgccaaggcagacattgagatggctggacccatggctgcagtaggcttgctaattgtcagctatgtggtctcgggaaagagtgtggacatgtacattgaaagagcaggtgacatcacatgggaaaaggacgcggaagtcactggaaacagtcctcggcttgacgtggcactggatgagagtggtgatttctccttggtagaggaagatggtccacccatgagagagatcatactcaaggtggtcctgatggccatctgtggcatgaacccaatagctataccttttgctgcaggagcgtggtatgtgtatgtgaagactgggaaaaggagtggcgccctctgggacgtgcctgctcccaaagaagtgaagaaaggagagaccacagatggagtgtacagagtgatgactcgcagactgctaggttcaacacaggttggagtgggagtcatgcaagagggagtcttccacaccatgtggcacgttacaaaaggagccgcactgaggagcggtgagggaagacttgatccatactggggggatgtcaagcaggacttggtgtcatactgtgggccttggaagttggatgcagcttgggatggacttagcgaggtacagcttttggccgtacctcccggagagagggccagaaacattcagaccctgcctggaatattcaagacaaaggacggggacatcggagcagttgctctggactaccctgcagggacctcaggatctccgatcctagacaaatgtggaagagtgataggactctatggcaatggggttgtgatcaagaatggaagctatgttagtgctataacccagggaaagagggaggaggagactccggttgaatgtttcgaaccctcgatgctgaagaagaagcagctaactgtcctggatctgcatccaggagccggaaaaaccaggagagttcttcctgaaatagtccgtgaagccataaaaaagagactccggacagtgatcttggcaccaactccagttgagagatcatactcaaggtggtccttgtggccatctgtggcacgtacccagacaacagcagtcaacgtcacccattctgggacagaaatcgttgatttgatgtgccatgccactttcacttcacgcttactacaacccatcagagtccctaattacaatctcaacatcatggatgaagcccacttcacagacccctcaagtatagctgcaagaggatacatatcaacaagggttgaaatgggcgaggcggctgccatttttatgactgccacaccaccaggaacccgtgatgcgtttcctgactctaactcaccaatcatggacacagaagtggaagtcccagagagagcctggagctcaggctttgattgggtgacagaccattctgggaaaacagtttggttcgttccaagcgtgagatctggagaagaaagcgcagcctgtctgacaaaggctggaaagcgggtcatacagctcagcaggaagacttttgagacagaatttcagaaaacaaaaaatcaagagtgggactttgtcataacaactgacatctcagagatgggcgccaacttcaaggctgaccgggtcatagactctaggagatgcctaaagccagtcatacttgatggtgagagagtcatcttggctgggcccatgcctgtcacgcatgctagtgctgctcagaggagaggacgtataggcaggaaccctaacaaacctggagatgagtacatgtatggaggtgggtgtgcagagactgatgaagaccatgcacactggcttgaagcaagaatgcttcttgacaacatctacctccaggatggcctcatagcctcgctctatcggcctgaggccgataaggtagccgccattgagggagagtttaagctgaggacagagcaaaggaagaccttcgtggaactcatgaagagaggagaccttcccgtctggctagcctatcaggttgcatctgccggaataacttacacagacagaagatggtgctttgatggcacaaccaacaacaccataatggaagacagcgtaccagcagaggtgtggacaaagtatggagagaagagagtgctcaaaccgagatggatggatgctagggtctgttcagaccatgcggccctgaagtcgttcaaagaattcgccgctggaaaaagaggagcggctttgggagtaatggaggccctgggaacactgccaggacacatgacagagaggtttcaggaagccattgacaacctcgccgtgctcatgcgagcagagactggaagcaggccttataaggcagcggcagcccaactgccggagaccctagagaccattatgctcttaggtttgctgggaacagtttcactggggatcttcttcgtcttgatgcggaataagggcatcgggaagatgggctttggaatggtaacccttggggccagtgcatggctcatgtggctttcggaaattgaaccagccagaattgcatgtgtcctcattgttgtgtttttattactggtggtgctcatacccgagccagagaagcaaagatctccccaagataaccagatggcaattatcatcatggtggcagtgggccttctaggtttgataactgcaaacgaacttggatggctggaaagaacaaaaaatgacatagctcatctaatgggaaggagagaagaaggagcaaccatgggattctcaatggacattgatctgcggccagcctccgcctgggctatctatgccgcattgacaactctcatcaccccagctgtccaacatgcggtaaccacttcatacaacaactactccttaatggcgatggccacacaagctggagtgctgtttggcatgggcaaagggatgccatttatgcatggggaccttggagtcccgctgctaatgatgggttgctattcacaattaacacccctgactctgatagtagctatcattctgcttgtggcgcactacatgtacttgatcccaggcctacaagcggcagcagcgcgtgctgcccagaaaaggacagcagctggcatcatgaagaatcccgttgtggatggaatagtggtaactgacattgacacaatgacaatagacccccaggtggagaagaagatgggacaagtgttactcatagcagtagccatctccagtgctgtgctgctgcggaccgcctggggatggggggaggctggagctctgatcacagcagcgacctccaccttgtgggaaggctctccaaacaaatactggaactcctctacagccacctcactgtgcaacatcttcagaggaagctatctggcaggagcttcccttatctatacagtgacgagaaacgctggcctggttaagagacgtggaggtgggacgggagagactctgggagagaagtggaaagctcgtctgaatcagatgtcggccctggagttctactcttataaaaagtcaggtatcactgaagtgtgtagagaggaggctcgccgtgccctcaaggatggagtggccacaggaggacatgccgtatcccggggaagtgcaaagctcagatggttggtggagagaggatatctgcagccccatgggaaggttgttgacctcggatgtggcagagggggctggagctattatgccgccaccatccgcaaagtgcaggaggtgagaggatacacaaagggaggtcccggtcatgaagaacccatgctggtgcaaagctatgggtggaacatagttcgtctcaagagtggagtggacgtcttccacatggcggctgagccgtgtgacactctgctgtgtgacataggtgagtcatcatctagtcctgaagtggaagagacacgaacactcagagtgctctctatggtgggggactggcttgaaaaaagaccaggggccttctgtataaaggtgctgtgcccatacaccagcactatgatggaaaccatggagcgactgcaacgtaggcatgggggaggattagtcagagtgccattgtctcgcaactccacacatgagatgtactgggtctctggggcaaaaagcaacatcataaaaagtgtgtccaccacaagtcagctcctcctgggacgcatggatggccccaggaggccagtgaaatatgaggaggatgtgaacctcggctcgggtacacgagctgtggcaagctgtgctgaggctcctaacatgaaaatcatcggcaggcgcattgagagaatccgcaatgaacatgcagaaacatggtttcttgatgaaaaccacccatacaggacatgggcctaccatgggagntacgaagcccccacgcaaggatcagcgtcttccctcgtgaacggggttgttagactcctgtcaaagccttgggacgtggtgactggagttacaggaatagccatgactgacaccacaccatacggccaacaaagagtcttcaaagaaaaagtggacaccagggtgccagatccccaagaaggcactcgccaggtaatgaacatggtctcttcctggctgtggaaggagctggggaaacgcaagcggccacgcgtctgcaccaaagaagagtttatcaacaaggtgcgcagcaatgcagcactgggagcaatatttgaagaggaaaaagaatggaagacggctgtggaagctgtgaatgatccaaggttttgggccctagtggatagggagagagaacaccacctgagaggagagtgtcacagctgtgtgtacaacatgatgggaaaaagagaaaagaagcaaggagagttcgggaaagcaaaaggtagccgcgccatctggtacatgtggttgggagccaggtttctggagtttgaatcactggggtttctgaatgaagatcactggatgggaagagagaactctggaggcggagttgaaggactgggactgcagagactgggctatgtccttgaggagatgagccaggcaccaggagggaagatgtacgcagatgacactgctggctgggacacccgcattagtaagtttgatctggagaatgaagctttgattaccaaccaaatggaggaagggcacagaactctggcgttggccgtgattaaatacacataccaaaacaaagtggtgaaggtcctcagaccagctgaaggaggaaaaacagttatggacatcatttcaagacaagaccagagagggagtggacaagttgtcacttatgctctcaacacattcaccaacttggtggtgcagcttatccggaacatggaagctgaggaagtgttagagatgcaagacttatggctgttgaggaagccagagaaagtgaccagatggttgcagagcaatggatgggatagactcaaacgaatggcggtcagtggagatgactgcgttgtgaagccaatcgatgataggtttgcacatgccctcaggttcttgaatgacatgggaaaagttaggaaagacacacaggagtggaaaccctcgactggatggagcaattgggaagaagtcccgttctgctcccaccacttcaacaagctgtacctcaaggatgggagatccattgtggtcccttgccgccaccaagatgaactgattggccgagctcgcgtttcaccaggggcaggatggagcatccgggagactgcctgtcttgcaaaatcatatgcgcagatgtggcagctcctttatttccacagaagagaccttcgactgatggctaatgccatttgctcggctgtaccagttgactgggtaccaactgggagaaccacctggtcaatccatggaaagggagaatggatgaccactgaggacatgctcatggtgtggaatagagtgtggattgaggagaacgaccatatggaggacaagactcctgtaacaaaatggacagacattccctatctaggaaaaagggaggacttatggtgtggatcccttatagggcacagaccccgcaccacttgggctgaaaacatcaaagacacagtcaacatggtgcgcaggatcataggtgatgaagaaaagtacatggactatctatccacccaagtccgctacttgggtgaggaagggtccacacccggagtgttgtaa

SEQ ID NO: 75 - DNA, 10272 bp, Zika virus
  Strain ArD128000 polyprotein gene, complete cds
  misc_feature (1324)..(1338): n is a, c, g, or t
atgaaaaacccaaagaggaaatccggaggattccggattgtcaatatgctaaaacgcggagtagcccgtgtaaaccccttggggggtttgaagaggctgccagccggacttctgctgggtcatggacccattagaatggttttggcgatactagcctttttgagatttacagcaatcaagccatcactgggcctcatcaatagatggggttcagtggggaaaaaagaggctatggagataataaagaagtttaagaaagatcttgctgccatgttgagaataatcaatgctaggaaggagaggaagagacgtggtgcagacaccagtatcggaatcattggcctcctgctgactacagccatggcagcagagattactagacgaggaagtgcatactacatgtacttggacaggagcgatgctgggaaggccatttcctttgctaccacattgggagtgaacaaatgccatgtacagatcatggatctcgggcacatgtgtgacgccaccatgagttatgagtgccctatgctagacgaaggagtggaaccagatgatgtcgattgctggtgcaacacgacatcaacttgggttgtgtacggaacctgtcatcacaaaaaaggtgaagcacggcgatctagaagagctgtgacgctcccttctcactccacaaggaagttgcaaacgcggtcgcagacctggttagaatcaagagaatacacgaagcacttgatcaaggttgaaaactggatattcaggaaccccgggtttgcgctagcggctgttgccattgcttggcttctgggaagctcgacgagccaaaaagtcatatacttggtcatgatattgttgattgccccggcatacagcatcaggtgcataggagttagcaatagagatttcgtagagggcatgtcaggtgggacctgggttgatgtcgtcttggaacatgggggttgcgtcaccgtgatggcacaggacaagccaacagttgacatcgagttggtcacgacaacggttagcaacatggccgaggtaagatcctactgctatgaggcatcaatatcggacatggcctcggacagccgctgtccaacacaaggtgaagcctaccttgacaagcaatcagacactcaatatgtctgcaaaagaacattagtggacagaggttggggaaacggttgtggactttttggcaaagggagcttggtgacatgtgccaagtttacgtgttctaagaagatgaccgggaagagcattcagccggagaacttggagtaccggataatgctatcagtgcatggatcccagcacagtgggatgnnnnnnnnnnnnnnnggacatgaaactgacgaaaacagagcaaaggtcgaggtcacacccaattcaccaagagcagaagcaaccttgggaggttttggaagcttgggacttgactgtgaaccaaggacaggccttgacttctcagatctgtattatctgaccatgaacaacaagcatcggttggtgcgcaaggagtggtttcatgacatcccattaccttggcatgctggtgcagacactggaactccacactggaacaacaaagaggcattggtggagttcaaggacgctcacgccaagaggcaaactgttgtggttctggggagccaagagggagctgttcacacggccctcgctggagctctggaggctgagatggatggtgcaaagggaaggctattctctggccatttgaaatgccgcctaaaaatggacaagcttaggttgaagggtgtgtcatattccctgtgtactgcagcgttcacatttaccaaggtcccagctgaaacattgcatggaacagttacagtggaggtgcagtatgcagggacagatggaccttgcaaggtcccagcccagatggcggtggacatgcagactctgaccccagttggaaggctgataaccgccaaccctgtgatcactgaaagtactgagaattcaaagatgatgttggaacttgacccaccatttggggattcttacattgtcataggagtcggggacaagaaaatcacccatcactggctcaagaaagggagctccatcggaaaggcatttgaagccactgtgagaggtgccaagagaatggcagtcttgggggacacagcctgggactttggatcagttggaggtgtgtttaattcattgggtaagggtgttcatcagatctttggagcagctttcaaatcactgtttggaggaatgtcctggttctcacagatcctcataggcacactgttggtgtggttgggtctgaacacaaagaatggatctatctccctcacatgcttagccctggggggagtgatgattttcctttccacggctgtttctgctgatgttgggtgctcggtggacttctcaaaaaaggaaacgagatgtggcacgggggtgttcgtctacaatgacgttgaagcctggagggaccgttacaagtatcatcctgactccccccgcagattggcagcagctgttaagcaggcttgggaagaggggatttgtgggatctcctccgtttcgagaatggaaaacatcatgtggaaatcagtggaaggggagcttaatgcaatcctagaggagaatggagtccaactgacagttgtagtggggtctgtaaaaaaccccatgtggagaggtccacaaagattgccagtgcccgtgaatgagctgccccatggctggaaagcctgggggaaatcgtactttgtcagagcggcaaagaccaacaacagttttgttgtcgacggagacacactgaaggagtgtccgctcaaacatagagcatggaatagcttccttgtggaggatcacgggtttgggattttccacaccagtgtttggctgaaggtcagagaggactactcattagagtgtgacccagccgtcataggaacagctgtcaagggaaaggaagctgcacacagtgatctatgctattggattgagagtgaaaagaatgacacatggaggctgaggagggcccacctgattgagatgaaaacatgtgaatggccaaagtctcacacattgtggacagatggagtagaagaaagtgatcttatcatacccaagtctttagctggtccactcagccaccacaacaccagagagggttacagaacccaagtgaaagggccatggcacagtgaagagcttgaaatccggtttgaggaatgtccaggcaccaaggtttacgtggaggagacatgcggaactagaggaccatctctgagatcaactactgcaagtggaagggtcattgaggaatggtgctgtagggaatgcacaatgcccccactatcgtttcgagcaaaagacggctgctggtatggaatggagataaggcccaggaaagaaccagagagcaacttagtgaggtcaatggtgacagcggggtcaaccgatcatatggaccacttctctcttggagtgcttgtgattctactcatggtgcaggaggggttgaagaagagaatgaccacaaagatcatcatgagcacatcaatggcagtgctggtagccatggtcttgggaggattctcaatgagtgatctggctaagcttgtgatcctgatgggtgccactttcgcagaaatgaacactggaggagatgtggctcacttggcattggttgcggcatttaaagtcagaccagccttgttggtttcctttatcttcagagccaactggacaccccgtgagagcatgctgctagccctggcttcgtgtctcctgcagactgcgatctccgctcttgaaggcgagctgatggtcctcgttaatggatttgctttggcctggttggcaatacgagcaatggccgtgccacgcactgacaatatcgctctagcaactctggccgctttaacaccattggccagaggcacactgctcgtggcatggagagcgggcctcgccacttgtggagggttcatgcttctttccctgaaagggaaaggtagtgtgaagaagaacctgccttttgtcatggccttggggttggccgctgtgaggatagtggaccccatcaatgtggtaggactactgttactcacaaggagtggaaaacggagctggccccccagtgaagtgcttacagctgttggcctgatatgtgcactggccggagggtttgccaaggcagacatagagatggctgggcccatggctgcagtaggcctgctaattgtcagttatgtggtctcgggaaagagtgtggacatgtacatcgaaagagcaggtgatatcacatgggaaaaagacgcggaagtcactggaaacagtccccggcttgacgtggcactggatgagagtggtgatttctccttggtagaggaggatggcccacccatgagagagatcatactcaaggtggtcctgatggccatctgtggcatgaacccaatagccatacccttcgctgcaggagcgtggtatgtgtatgtaaagactgggaaaaggagtggtgccctctgggacgtgcctgctcccaaagaagtgaaaaaaggagagactacagatggagtgtacagagtgatgactcgcagactgctgggttcaacacaggttggagtgggggtcatgcaagagggagtcttccacaccatgtggcacgtcacaaaaggagctgcattgaggagcggtgaaggaagacttgatccatattggggggacgtcaagcaggacttggtgtcatattgtgggccgtggaagttggacgcaacctgggatggactaagtgaagtgcagcttttggccgtaccccccggagagagggctagaaacattcagactctgcctggaatattcaagacaaaggatggggacatcggagcggttgctctagactaccccgcaggaacctcaggatctccaatcctagacaaatgcggaagagtgataggactttatggcaatggggttgtgatcaagaatggaagctatgtcagtgcaataacccagggaaaaagggaggaggaggccccagttgagtgctttgaaccctcgatgctgaggaagaagcagctaacagtcttggatctgcatccaggagccggaaaaaccaggagggttcttcctgaaatagtccgtgaagccataaaaaagagactccggacagtgatcttggcaccaactagggttgtcgctgctgagatggaggaggccttgagaggacttccggtgcgttacatgacaacagcagtcaacgtcacccattctgggacagaaatcgttgatttgatgtgccatgccactttcacttcacgcttactacaacccatcagagtccctaattacaatctcaacatcatggatgaagcccacttcacagacccctcaagtatagctgcaagaggatacatatcaacaagggttgaaatgggcgaggcggctgccatttttatgactgccacaccaccaggaacccgtgatgcgtttcctgactctaactcaccaatcatggacacagaagtggaagtcccagagagagcctggagctcaggctttgattgggtgacagaccattctgggaaaacaatttggtttgttccaagtgtgagaaacggaaatgaaatcgcagcctgtctgacaaaggctggaaagcgggttatacagctcagcaggaagacttttgagacagagtttcagaagacaaaaaatcaagagtgggactttgtcataacaactgacatttcagagatgggtgccaatttcaaggctgaccgggtcatcgattccaggagatgcctaaagccagtcatacttgatggtgagagagtcatcctggctgggcccatgcctgtcacgcatgccagtgctgctcagaggagaggacgtataggcaggaaccccaacaaacccggagatgagtacatgtatggaggtgggtgtgcagagactgatgaagaccatgcacactggcttgaagcaagaatgcttcttgacaacatttacctccaagatggcctcatagcctcgctctatcggcctgaggccgacaaggtagccgccattgagggagagttcaagctgaggacagagcaaaggaagacctttgtggaactcatgaagagaggagaccttcccgtttggctggcctatcaagtagcatctgccggaataacttacacagacagaagatggtgctttgatggcactaccaacaacaccataatggaagacagtgtaccagcagaggtgtggaccaagtatggagagaagagagtgcttaaaccgaggtggatggatgctagggtctgttcagatcatgcggctctgaagtcgttcaaagaatttgccgctgggaagagaggagcggctttgggagtaatggatgccctgggaacattgccaggacacatgacagagaggtttcaggaagccattgacaatcttgctgtgctcatgcgagcagagactggaagtaggccctacaaagcagcggcagctcaactgccggagaccctagagaccatcatgcttttgggcttattgggaacagtttcgctaggaatcttctttgtcttgatgcggaacaagggcatcgggaagatgggcttcggaatggtaacccttggggccagcgcatggctcatgtggctctcggaaattgaaccagccagaatcgcatgtgtcctcattgtcgtgtttttgttactggtggtgctcatacccgagccagagaagcaaagatctccccaggataatcaaatggcaatcatcatcatggtggcagttggccttttgggtttgataactgcaaatgaactcggatggctggaaaggacaaaaagtgatatagcttatctgatgggaaggaaagaagaggggacaaccataggattctcaatggatattgatctgcggccagcctctgcctgggctatttatgccgcattgacaactctcatcaccccagccgtccaacatgcggtaaccacctcatacaacaactactccctgatggcgatggccacacaagctggagtgctgtttggcatgggcaaagggatgccattttatgcatgggactttggagtcccgctgctaatgataggttgctactcacagttaacacccctgaccctgatagtagccatcattctgcttgtagcacactacatgtacttgatcccaggtttgcaggcagcagcagcacgtgctgcccagaagaggacagcagctggcatcatgaaaaatcccgttgtggatggaatagtggtgactgacattgacacaatgacaattgacccccaagtggagaagaagatgggacaagtgttactcatagcagtagctgtctccagtgctgtgctgctgcggaccgctgggggatggggggaggctggggctctgatcacagcagctacctccaccttatgggaaggctctccaaacaaatactggaactcctctacagccacctcactatgcaacatctttagaggaagttatttggcaggggcttcccttatttacacagtgacaagaaatgccggtctggttaagagacgtggaggtggaacgggagagaccctgggagagaagtggaaagcccgcctgaaccagatgtcggccctggagttttactcttacaaaaagtcaggcatcaccgaagtgtgtagggaggaggcgcgccgcgctctcaaggatggagtggccacaggagggcatgctgtatcccggggaagcgcaaagcttagatggttggtagagagaggatacctgcagccccatggaaaggttgttgaccttggatgtggcagaggaggctggagttattacgctgccactatccgtaaagtgcaggaggtcagaggatacacaaagggaggtcctggtcatgaagaacccatgctggtgcaaagctatgggtggaacatagttcgcctcaagagtggagtggacgtcttccacatggcggctgagccgtgtgacactctgctgtgtgacataggcgagtcatcatctagtcctgaagtggaagagacgcgaacactcagagtgctctccatggtagaagactggcttgagaaaagaccaggggccttctgcataaaggtgctgtgcccatacaccagcacaatgatggagaccatggagcgactgcaacgtaggcatgggggaggattggtcagagtgccattgtcccgcaactccacacatgagatgtattgggtctctggagccaaaagtaacatcataaagagtgtgtccaccacaagtcagctcctcttgggacgcatggatgggcctaggaggccagtgaaatatgaggaggatgtgaacctcggctcaggcacacgagctgtggcaagctgcgctgaggctcccaacatgaagatcattggtaggcgcattgagagaatccgcaatgaacatgcagagacatggttctttgatgaaaaccacccatacaggacatgggcctaccatgggagctacgaagcccccacgcaggggtcagcgtcatccctcgtgaatggggttgttagactcttgtcaaagccctgggatgtggtgactggagttacaggaatagctatgactgacaccacgccatacggccaacaaagagtcttcaaggaaaaagtggacacaagggtgccagatccccaagaaggcactcgccaagtaatgaacatagtttcgtcttggctatggaaggagctaggaaaacgcaagcgaccacgtgtctgcaccaaagaagagttcatcaataaggtgcgcagcaatgcagcactgggagcaatatttgaagaggaaaaagaatggaagacagctgtagaagctgtgaatgatccaagattttgggctctagtggacaaggaaagagaacaccacctgagaggagagtgtcacagctgtgtgtacaacatgatgggtaaaagagaaaagaagcaaggagaattcgggaaagcaaaaggcagccgcgcaatctggtacatgtggttgggagccagatttttggagtttgaagctcttggattcttgaacgaggatcactggatgggaagagaaaactcaggaggtggtgttgaagggctaggactgcaaaggcttggatatatcctagaagaaatgaaccgggcaccaggaggaaagatgtatgcagatgacaccgctggctgggacacccgtattagtaagtttgatctagagaatgaagccctgatcactaaccagatggaagaagggcacagagctctggcgttggccgtgattaaatacacataccaaaacaaagtggtgaaggttctcagaccagctgaaggagggaaaacagtcatggacatcatctcaagacaagaccagagagggagtggacaagttgttacttatgccctcaacacattcaccaacctggtggtgcagcttatccggaacatggaggctgaggaagtgctagagatgcatgatctgtggttgttgaggaaaccagagaaagtgaccagatggttgcagagtaatggatgggacagactcaaacggatggcagttagtggagatgactgcgttgtaaagccaattgatgataggtttgcacatgccctcaggttcttgaatgacatgggaaaggttaggaaagacacacaggaatggaagccctcgactggatggagcaattgggaggaggtcccgttctgttctcaccacttcaacaagctgcacctcaaggacgggagatccattgtggtcccctgccgccaccaagatgaactgattggccgagcccgtgtctcaccaggggcaggatggagcatccgtgagactgcttgccttgcaaaatcatatgcacagatgtggcagcttctttatttccacagaagagatctccgactgatggccaatgccatttgttcggctgtgccagttgattgggtaccaactgggagaaccacctggtcaatccatggaaagggagaatggatgactactgaggacatgctcatggtgtggaatagagtgtggattgaggagaacgaccacatggaggacaagacccctgttccaaaatggacagaaattccctacttggggaaaagggagtccctatggtgtggatacattatagggcacagacctcgcaccacttgggctgagaacatcaaagacacagtcaacatggtgcttaggctcataggtgatgaagaaaagtacatggactacctatccacccaagtacgctacttgggtgaggaagggtccacacctggagtgctgtaa

SEQ ID NO: 76 - DNA, 10272 bp, Zika virus
  Strain ArD7117 polyprotein gene, complete cds
  misc_feature (4309)..(4309): n is a, c, g, or t
  misc_feature (5225)..(5226): n is a, c, g, or t
atgaaaaacccaaagaagagatccggaggattccggattgtcaatatgctaaaacgcggagtagcccgtgtaaaccccttggggggtttgaagaggctgccggccggacttctgctgggccatggacccatcagaatggttttggcgatactagcctttttgagattcacagcaatcaagccatcactgggcctcatcaatagatggggttccgtggggaagaaggaggctatggaaataataaaaaagttcaagaaagaccttgctgccatgttgagaattatcaatgctaggaaggagaggaagagacgtggcgctgacaccagcatcggaatcgtcggcctcctgctgaccacagccatggcagccgagatcaccagacgtgggagtgcatactacatgtacttggacaggagcgatgctggtaaggccatttcttttgctaccacattgggggtgaacaaatgccatgtacagatcatggacctcgggcacatgtgtgacgccaccatgagttatgagtgccccatgctggacgagggagtggagccagatgacgtcgattgctggtgcaacacgacatcaacttgggttgtgtacggaacctgtcaacataaaaaaggtgaagcacgacgatccagaagagccgtgacgcttccttctcactccacaaggaagctgcaaacgcgatcacagacttggctagaatcaagagaatacacaaagcacctgatcaaggttgagaattggatattcaggaaccccgggtttgcgctagtggctgtagctattgcctggctcctgggaagctcgacgagccaaaaagtcatatacttggtaatgatattgttgattgccccggcatacagcatcaggtgcataggagttagcaatagagacttcgtggagggcatgtcaggtgggacctgggttgatgttgtcttggaacatgggggttgcgtcaccgtgatggcacaggacaagccaacagttgacatcgagttggtcacgacaacggttagcaacatggccgaggtaagatcctactgctatgaggcatcaatatcggacatggcttcggacagccgctgtccaacacaaggtgaagcctaccttgacaagcagtcagacactcaatatgtctgcaagagaacattggtggatagaggttggggaaatgggtgtggactttttggcaaagggagcttggtgacatgtgccaagtttacgtgctccaagaaaatgacaggcaagagcatccagccggagaacttggagtaccggataatgctatcagtgcatggatcccagcacagtgggatgattgtgaatgacataggacatgaaactgacgaaaacagagcaaaagtcgaggtcacacccaattcaccaagagcagaagcaaccttgggaggttttggaagcttgggacttgactgtgaaccaaggacaggccttgacttctcagatctgtattacctgaccatgaacaataagcattggttggtgcacaaggagtggtttcatgacatcccattaccttggcatgctggtgcagacactggaactccacactggaacaacaaagaggcattggtggagtttaaggacgcccacgccaagaggcaaactgttgtggttctggggagccaagagggagctgttcacacggccctcgctggagctttggaggctgagatggatggtgcaaagggaaggctattctctggccatttgaaatgccgcctaaaaatggacaagcttaggttgaagggtgtgtcatattccctgtgtaccgcagtgtgtaccgcagcgaaggtcccagctgaaacattgcatggaacagtcacagtggaggtgcagtatgcagggacagatggaccctgcaaggtcccagcccagatggcggtagacatgcagaccctgaccccagttggaaggctgataaccgccaaccctgtgatcactgaaagtactgagaattcaaagatgatgttggagctcgacccaccatttggggattcttacattgtcataggagtcggggacaagaaaatcacccatcactggcatcggagtggtagcaccatcggaaaggcatttgaagccactgtgagaggtgccaagagaatggcagtcttgggggacacagcctgggactttggatcagttgggggtgtgtttaattcattgggtaagggtattcaccagatctttggagcagcttttaaatcactgtttggaggaatgtcctggttctcacagatcctcataggcacactgttggtgtggttaggtctgaacacaaagaatggatctatctccctcacatgcttagccctggggggagtgatgatcttcctttccacggctgtttctgctgatgttgggtgctcggtggacttctcaaaaaaggaaacgagatgtggcacgggggtgttcgtctacaatgacgttgaagcctggagggaccggtacaagtaccatcctgactccccccgcagattggcagcagctgtcaagcaggcttgggaagaggggatttgtgggatctcctccgtttcgagaatggaaaacatcatgtggaaatcagtggaaggggagcttaatgcaatcctagaggagaatggagtccaactgacagttgtagtggggtctgtaaaaaaccctatgtggagaggtccacaaagattgccagtgcccgtgaatgagctgccccatggctggaaagcctgggggaaatcgtactttgtcagagcggcaaagaccaacaacagttttgttgtcgacggtgacacactgaaggagtgtccgctcaaacatagagcatggaatagcttccttgtggaggatcacgggtttgggatcttccacaccagtgtttggctgaaggtcagagaggactactcattagagtgtgacccagccgtcataggaacagctgtcaagggaaaggaagctgcacacagtgatctaggctattggattgagagtgaaaagaatgacacatggaggctgaggagggctcatctgattgagatgaaaacatgtgagtggccaaagtctcacacactgtggacagatggagtggaagaaagtgatctgatcatacccaagtccttagctggtccactcagccaccacaacaccagagagggttacagaactcaagtgaaagggccatggcatagtgaagagctcgaaatccggtttgaggagtgcccaggaaccaaggttcacgtggaggagacatgcggaactagaggaccatctctgagatcaactactgcaagtggaagggtcatagaggaatggtgctgtagggaatgcacaatgcctccactatcgttccgggcgaaagacggctgctggtatggaatggagataaggcccagaaaggaaccagagagcaacttagtaaggtctatggtgacagcaggatcaaccgatcatatggatcacttctctcttggagtgcttgtgattctactcatggtgcaggaaggtttgaagaagagaatgaccacaaagatcataatgagcacatcaatggcagtgctggtagccatggtcttgggaggattctcaatgagtgacctggctaagcttgtgatcctgatgggtgccactttcgcagaaatgaacactggaggagatgtggctcacttggcattggttgcggcatttaaagtcagaccagccttgttggtttccttcatcttcagagccaactggacaccccgtgagagcatgctgctagccctggcttcgtgtctcctgcagactgcgatctccgctcttgaaggcgagctgatggtcctcgttaatggatttgctttggcctggttggcaatacgagcaatggccgtgccacgcactgacaatatcgctctagcaattctggctgctctaacaccattagccagaggcacactgctcgtggcatggagagcgggcctcgccacttgtggagggttcatgctcctttccctgaaagggaaaggtagtgtgaagaagaacctgccttttgtcatggccttggggttgaccgctgtgaggatagtggaccccatcaatgtggtaggactactgttactcacacggagtggaaaacggagctggccccctagtgaagtgcttacagctgttggcctgatatgtgcactggccggagggtttgccaaggcagatatagagatggctgggcccatggctgcagtaggcctgctaattgtcagttatgtggtctcgggaaagagtgtggacatgtacatcgaaagagcaggtgatatcacatgggaaaaagacncggaagtcactggaaacagtcctcggcttgacgtggcactagatgagagtggtgatttctccttggtagaggaggatggcccacccatgagagagatcatactcaaggtggtcctgatggccatctgtggcatgaacccaatagccatacccttcgctgcaggagcgtggtatgtgtatgtaaagactggaaaaaggagtggtgccctctgggacgtgcctgctcccaaagaagtgaaaaaaggagagactacagatggagtgtacagagtgatgactcgcagactgctgggttcaacacaggttggagtgggagtcatgcaagagggagtcttccacaccatgtggcacgtcacaaaaggagccgcattgaggagcggtgaaggaagacttgatccatattggggggacgtcaagcaggacttggtgtcatattgtgggccgtggaagttggatgcagcctgggatggactaagtgaagtgcagcttttggccgtaccccccggagagagggctagaaacattcagactctgcctggaatattcaagacaaaggatggggacatcggagcagtcgctctagactaccccgcaggaacctcaggatctccaatcctagacaaatgcggaagagtgataggactttatggcaatggggttgtgatcaagaatggaagctatgttagtgccataacccagggaaaaagggaggaggaggctccagttgagtgctttgaaccctcgatgctgaggaagaagcagctaacagtcttggatctgcatccaggagccgggaaaaccaggagggttcttcctgaaatagtccgtgaagccataaagaagagacttcgcacattgatcctagcaccaaccagggtcgttgctgctgagatggaggaagccctaagaggacttcnngtgcgttacatgacaacagcagtcaacgtcacccattctgggacagaaatcgttgatttgatgtgccatgccactttcacttcacgcttactacaacccatcagagtccctaattacaatctcaacatcatggatgaagcccacttcacagacccctcaagtatagctgcaagaggatacatatcaacaagggttgaaatgggcgaggcggctgccatttttatgactgccacaccaccaggaacccgtgatgcgtttcctgactctaactcaccaatcatggacacagaagtggaagtcccagagagagcctggagctcaggctttgactgggtgacggaccattctgggaaaacaatttggtttgttccaagtgtgagatctggagaagaaagcgcagcctgtctgacaaaggctggaaagcgggttatacagctcagcaggaagacttttgagacagagtttcagaagacaaaaaatcaagagtgggactttgtcataacaactgacatttcagagatgggtgccaatttcaaggctgaccgggtcatagattccaggagatgcctaaagccagtcatactcgatggtgagagagtcatcctggctgggcccatgcctgtcacgcatgccagtgctgctcagaggagaggacgtataggcaggaaccccaacaaacctggagatgagtacatgtatggaggtgggtgtgcagagactgatgaagaccatgcacactggcttgaagcaagaatgcttcttgacaacatttacctccaggatggcctcatagcctcgctctatcggcctgaggccgacaaggtagccgccattgagggagagttcaagctgaggacagagcaaaggaagacctttgtggaactcatgaagagaggagaccttcccgtttggctggcctatcaagtagcatctgccggaataacttacacagacagaagatggtgctttgatggcactaccaacaacaccataatggaagacagtgtaccagcagaggtgtggaccaagtatggagagaagagagtgcttaaaccgaggtggatggatgctagggtctgttcagatcatgcggctttgaagtcgttcaaagaatttgccgctgggaagagaggagcggctttgggagtgatggatgccctgggaacattgccaggacacatgacagagaggtttcaggaagccattgacaatctcgctgtgctcatgcgagcagagactggaagtaggccctacaaagcagcggcagctcaactgccggagaccctagagaccatcatgcttttgggcttattgggaacagtttcgctaggaatcttctttgtcttgatgcggaacaagggcatcgggaagatgggcttcggaatggtaacccttggggccagcgcatggctcatgtggctttcggaaattgaaccagccagaatcgcatgtgtcctcattgtcgtgtttttgttactggtggtgctcatacccgagccagagaagcaaagatctccccaggataatcaaatggcaatcatcatcatggtggcagttggccttctgggtttgataacagcaaatgaactcggatggctggaaaggacaaaaagtgatatagctcatctaatgggaaggaaagaagaggggacaaccataggattctcaatggatattgatctgcggccagcctccgcctgggctatttatgccgcattgacaactctcatcaccccagccgtccaacatgcggtaaccacctcatacaacaactactccctgatggcgatggccacacaagctggagtgctgtttggcatgggcaaagggatgccattttatgcatgggactttggagtcccgctgctaatgatgggttgctactcacaattaacacccctgaccctgatagtggccatcattctgcttgtggcacactacatgtacttgatcccaggtttgcaggcagcagcagcacgtgctgcccagaagaggacagcagctggcatcatgaagaatcccgttgtggatggaatagtggtgactgacattgacacaatgacaattgacccccaagtggagaagaagatgggacaagtgttactcatagcagtagctgtctccagtgctgtgctgctgcggaccgcttggggatggggggaggctggggctctgatcacagcagcaacctccaccttatgggaaggctctccaaacaaatactggaactcctccacagccacctcactgtgcaacatctttagaggaagttatttggcaggggcttcccttatttacacagtgacaagaaatgccggtctggttaagagacgtggaggtggaacgggagagaccctgggagagaagtggaaagcccgcctgaaccagatgtcggccttggagttttactcttacaaaaagtcaggcatcaccgaagtgtgtagggaggaggcgcgccgcgccctcaaggatggagtggccacaggaggacatgctgtatcccggggaagcgcaaagcttagatggttggtagagagaggatacctgcagccccatggaaaggttgttgaccttggatgtggcagaggaggctggagttattacgctgccaccatccgtaaagtgcaggaggtcagaggatacacaaagggaggtcctggtcatgaagaacccatgctggtgcaaagctatgggtggaacatagttcgcctcaagagtggagtggacgtcttccacatggcggctgagccgtgtgacactctgctgtgtgacatcggcgagtcatcatctagtcctgaagtggaagagacgcgaacactcagagtgctctccatggtgggagactggcttgagaaaagaccaggggccttctgcataaaggtgctgtgcccatacaccagcacaatgatggagaccatggagcgactgcaacgtaggcatgggggaggattggtcagagtgccattgtcccgcaactccacacatgagatgtattgggtctctggagccaaaagtaacatcataaagagtgtgtccaccacaagtcagctcctcttgggacgcatggatgggcctaggaggccagtgaaatatgaggaggatgtgaacctcggctcaggcacacgagctgtggcaagctgcgctgaggctcccaacatgaagatcattggtaggcgcattgagagaatccgcaatgaacatgcagagacatggttctttgatgaaaaccacccatacaggacatgggcctaccatgggagctacgaagcccccacgcaggggtcagcgtcatccctcgtgaacggggttgttagactcttgtcaaaaccctgggatgtggtgactggagttacaggaatagctatgactgacaccacgccatacggccaacaaagagtcttcaaggaaaaagtggacactagggtgccagatccccaagaaggcactcgccaagtaatgaacatggtctcgtcttggctatggaaggagctgggaaaacgcaagcggccacgtgtctgcaccaaagaagagttcattaataaggtgcgcagcaatgcagcactgggagcaatatttgaagaggaaaaagaatggaagacagctgtagaagctgtgaatgatccaagattttgggctctagtggacaaggaaagagaacaccacctgagaggagagtgtcacagctgtgtgtacaacatgatgggtaaaagagaaaagaagcaaggagaattcgggaaagcaaaaggcagccgcgcaatctggtacatgtggttgggagccagatttttggagtttgaagctcttggattcttgaacgaggaccactggatgggaagagaaaactcaggaggtggcgttgaagggctaggactgcaaaggcttggatatatcctagaagaaatgaaccgggcaccaggaggaaagatgtatgcagatgacaccgctggctgggacacccgcattagcaagtttgatctagagaatgaagccctgatcactaaccagatggaagaagggcacagagctctggcgttggccgtgattaaatacacataccaaaacaaagtggtgaaggttctcagaccagctgaaggagggaaaacagtcatggacatcatctcaagacaagaccagagagggagcggacaagttgttacttatgctctcaacacattcaccaacctggtggtgcagcttatccggaacatggaggctgaggaagtgctagagatgcatgatctatggttgttgaggaagccagagaaagtgaccagatggttgcagagcaatggatgggacagactcaaacggatggcagttagtggagatgactgcgttgtaaagccaattgatgataggtttgcacatgccctcaggttcttgaatgacatgggaaaggttaggaaagacacacaggaatggaaaccctcgactggatggagcaattgggaagaggtcccgttctgttctcaccacttcaacaagctgcacctcaaggacgggagatccattgtggtcccctgccgccaccaagatgaactgattggccgagcccgtgtctcaccaggggcaggatggagcatccgggagactgcttgtcttgcaaaatcatatgcacagatgtggcagcttctttatttccacaaaagagacctccgactgatggccaatgccatttgttcggctgtgccagttgactgggtaccaactgggagaaccacctggtcaatccatggaaagggagaatggatgactactgaggacatgctcatggtgtggaatagagtgtggattgaggagaacgaccacatggaggacaagacccctgtaacaaaatggacagacattccctatttggggaaaagggaggacttatggtgtggatcccttatagggcacagacctcgcaccacttgggctgagaacatcaaagacacagtcaacatggtgcgtaggatcataggtgatgaagaaaagtacatggactacctatccacccaagtacgctacttgggtgaggaagggtccacacctggagtgctgtaa

SEQ ID NO: 77 - DNA, 10272 bp, Zika virus
  Strain ArB1362 polyprotein gene, complete cds
  misc_feature (1336)..(1356): n is a, c, g, or t
  misc_feature (5225)..(5226): n is a, c, g, or t
  misc_feature (5229)..(5229): n is a, c, g, or t
  misc_feature (8947)..(8947): n is a, c, g, or t
atgaaaaacccaaagaagaaatccggaggattccggattgtcaatatgctaaaacgcggagtagcccgtgtaaaccccttgggaggtttgaagaggctgccagccggacttctgctgggtcatggacccattagaatggttttggcgatactagcctttttgagatttacagcaatcaagccatcactgggcctcatcaatagatggggttcagtggggaaaaaagaggctatggagataataaagaagtttaagaaagatcttgctgccatgttgagaataatcaatgctaggaaggagaggaagagacgtggtgcagacaccagtatcggaatcattggcctcctgctgactacagccatggcagcagagattactagacgaggaagtgcatactacatgtacttggacaggagcgatgctgggaaggccatttcctttgctaccacattgggagtgaacaaatgccatgtacagatcatggatctcgggcacatgtgtgacgccaccatgagttatgagtgccctatgctagacgaaggagtggaaccagatgatgtcgattgctggtgcaacacgacatcaacttgggttgtgtacggaacctgtcatcacaaaaaaggtgaagcacggcgatctagaagagctgtgacgctcccttctcactccacaaggaagttgcaaacgcggtcgcagacctggttagaatcaagagaatacacgaagcacttgatcaaggttgaaaactggatattcaggaaccccgggtttgcgctagcggctgttgccattgcttggcttctgggaagttcgacgagccaaaaagtcatatacttgatcatgatactgctgattgccccggcatacagcatcaggtgcattggagtcagcaacagagacttcgtggaaggcatgtcaggtgggacctgggttgatgtcgtcttggaacatggaggttgcgtcaccgtaatggcacaggacaagccaacagttgacatagagttggtcacgacaacggttagcaacatggctgaggtaagatcctactgctacgaggcatcaatatcggacatggcttcggatagtcgctgcccaacacaaggtgaagcctaccttgacaagcaatcagacactcaatatgtttgcaaaagaacattggtggacagaggttggggaaatgggtgtggactttttggcaaagggagcctggtgacatgtgccaagttcacgtgttccaagaagatgaccgggaagagcatccagccggagaatctggagtatcgaataatgctatcggtgcatggctcccagcacagcgggatgattgttaatgacnnnnnnnnnnnnnnnnnnnnnaacagagcggaagtcgaggtcacgcctaattcaccaagagcagaagcaaccttgggaggctttggaagtttaggacttgattgtgaaccaaggacaggccttgacttttcagatttgtattacctgaccatgaacaataagcactggttagtccacaaagagtggtttcatgacatcccattgccttggcatgctggggcagacaccggaactccacactggaacaacaaagaggcattggtagagttcaaggatgcccacgccaagaggcaaaccgtcgtcgttctggggagccaggaaggagctgttcacacggctcttgctggagctttggaggctgagatggatggtgcaaaaggaaggctgttctctggccatttgaaatgccgcctaaaaatggacaagcttagattgaagggcgtgtcatattccttgtgcaccgcagcgttcacattcaccaaggtcccagctgaaacactgcatggaacagtcacagtggaggtgcagtatgcagggacagatggaccctgcaaggtcccagcccagatggcggtggacatgcagactttgaccccagtcggaaggctgataactgccaaccccgtgattactgaaagcactgaaaattcaaagatgatgttggagctcgacccaccatttggggattcttacattgtcataggagttggagataagaaaatcacccaccactggcataggagtggtagcaccatcggaaaagcatttgaggccactgtgagaggtgccaagagaatggcagttttgggggacacagcttgggactttggatccgtcgggggtgtgttcaactcattgggcaagggcatccaccagatctttggagcagccttcaaatcactgtttggaggaatgtcctggttctcacagatcctcataggcacgctgctagtgtggttgggcttgaacacaaagaatggatccatctccctcacatgcttggccctggggggagtgatgatcttcctctccacggctgtttctgctgatgtggggtgctcggtggacttctcaaaaagagaaacgagatgtggcacgggggtgttcgtctacaatgacgttgaagcctggagggataggtacaagtaccatcctgactccccccgcagattggcagcagcagtcaagcaggcttgggaagaggggatttgtgggatctcctccgtttcaagaatggaaaacatcatgtggaaatcagtggaaggggagctcaatgctatcttagaggagaatggagttcaactgacagttgttgtgggatctgtaaaaaaccccatgtggagaggtccacaaagattgccagtgcctgtaaatgagctgccccatggctggaaagcctgggggaaatcatattttgtcagagcggcaaagaccaacaacagttttgttgtcgacggtgacacactgaaggaatgtccgctcaaacacagagcatggaacagtttccttgtggaggatcacgggtttggggtcttccacactagtgtttggcttaaggttagagaagattactcactagagtgtgacccagccgtcataggaacagctgttaagggaaaggaggccgcgcacagtgatctaggctactggattgaaagtgaaaagaatgacacatggaggttgaagagggcccacctgattgagatgaaaacatgtgagtggccaaagtctcacacactgtggacagatggagtagaagaaagtgatctgatcatacccaagtctttagctggtccactcagccaccacaacaccagagagggttacagaactcaggcaaaagggccatggcatagtgaagagcttgaaatccggtttgaggaatgtccaggcaccaaggttcacgtggaggagacatgcggaactagaggaccatctctgagatcaaccactgcaagtggaagggtcattgaggaatggtgctgtagagaatgcacaatgcccccactatcatttcgagcgaaagacggctgctggtatggaatggagataaggcccaggaaagaaccagagagcaatttagtgaggtcaatggtgacagcgggatcaaccgatcacatggaccacttctctcttggagtgcttgtgattctactcatggtgcaggaagggctgaagaagagaatgaccacgaagatcattgtgagcacatcaatggcagtgctggtagccatgatcttgggaggattctcaatgagtgacctggctaagcttgtgatcctgatgggtgctactttcgcagaaatgaatactggaggagatgtggctcacttggcattggtcgcggcattcaaagtcagaccagccttgctggtctccttcattttcagagccaattggacaccccgtgagagcatgctgctagccctggcttcgtgtcttttgcaaactgcaatttcagctcttgaaggtgacttgatggtcctcgttaatggatttgctttggcctggttggcaatacgagcaatggccgtgccacgcactgacaacattgctctagcaatcctggctgctctgacaccactagcccgaggcacactgctcgtggcatggagagcgggcctcgccacttgtggagggttcatgctcctctccttgaaaggaaaaggtagtgtgaagaagaacctgccatttgtcatggccttgggaatgaccgctgtgaggatagtggaccccattaacgtggtgggactactactactcacaaggagtgggaagcggagctggccccccagtgaagtgcttacagctgttggcctgatatgtgcactggccggagggtttgccaaggcagacattgagatggctgggcccatggctgcagtaggcttgctaattgtcagttatgtggtctcaggaaagagtgtggatatgtacattgaaagagcaggtgacatcacatgggaaaaagacgcggaagttactggaaatagtcctcggcttgacgtggcactagatgagagtggtgatttctctctggtagaggaagatggtccacccatgagagagatcatactcaaggtggtcctgatggccatctgtggcatgaacccaatagccataccttttgctgcaggagcgtggtatgtgtatgtgaagactgggaaaaggagtggtgccctctgggatgtgccagctcctaaagaagtgaaaaaaggagagaccacagatggagtatacagagtgatgacccgcagattgctgggttcaacacaggttggagtgggagtcatgcaggagggagtcttccacaccatgtggcacgtcacaaaaggagccgcactgaggagcggtgaagggagacttgatccatactggggtgatgtcaagcaggacttggtgtcatactgtgggccttggaagctggatgcagcttgggatggacttagtgaggtgcagctcttggcagtacctcccggagagagggccagaaacatccagactctgcctggaatattcaagacaaaggatggggacatcggagcagttgctctggactaccccgcaggaacctcaggatctccgatcctagacaaatgcggaagagtgataggactttatggcaatggggttgtgatcaagaatggaagctatgttagtgccataacccagggaaagagggaggaggagactccggttgaatgtttcgaaccctcgatgctgaagaagaagcagctaactgtcctggacctgcatccaggagccggaaagactaggagagttcttcctgaaatagtccgtgaagccataaaaaagagactccgcacagtgatcttggctccaaccagggttgtcgctgctgagatggaggaagccttgagaggacttcnngtncgttacatgacaacagcagtcaacgtcacccattctgggacagaaatcgttgatttgatgtgccatgccactttcacttcacgcttactacaacccatcagagtccctaattacaatctcaacatcatggatgaagcccacttcacagacccctcaagtatagctgcaagaggatacatatcaacaagggttgaaatgggcgaggcggctgccatttttatgactgccacaccaccaggaacccgtgatgcgtttcctgactctaactcaccaatcatggacacagaagtggaagtcccagagagagcctggagctcaggctttgattgggtgacagaccattctgggaaaacagtttggttcgttccaagtgtgagaaatggaaatgaaatcacagcctgcctgacaaaggctggaaagcgggtcatacagctcagcaggaagacttttgagacagagttccagaaaacaaaaaaccaagagtgggactttgtcataacaactgacatctcagagatgggcgccaatttcaaggctgaccgggtcatagactctaggagatgcctaaagccagtcatacttgatggtgagagagtcatcttggctgggcccatgcctgtcacgcatgctagtgctgctcagaggagaggacgtataggcaggaaccctaacaaacctggagatgagtacatgtatggaggtgggtgtgcagagactgatgaagaccacgcacactggcttgaagcaagaatgcttcttgacaacatctacctccaggatggcctcatagcctcgctctatcggcctgaggccgataaggtggccgccattgagggagagtttaagctgaggacagagcaaaggaagacctttgtggaacttatgaagagaggagaccttcccgtttggctagcctatcaggttgcatctgccggaataacttacacagacagaagatggtgctttgatggcacaactaacaacaccataatggaagacagtgtaccagcagaggtgtggacaaaatatggagagaagagagtgctcaaaccaagatggatggatgctagagtctgttcagatcatgccgccctgaagtcgttcaaagagtttgctgccgggaaaagaggagcggctttgggagtaatggaggccctgggaacattgccaggacacatgacagagaggtttcaggaagccattgacaatctcgctgtgcttatgcgagcagaaactggaagcaggccttacaaggcagcggcagccccactgccggagaccctagagaccatcatgctcttaggtttgctgggaacagtttcgttggggatattctttgtcttgatgcggaacaagggcatcgggaagatggggtttggaatggtaactcttggggccagtgcatggctcatgtggctttcggaaattgaaccagccagaattgcatgtgtcctcattgttgtgtttttgttactggtggtactcatacctgagccagagaagcaaagatctccccaggataaccagatggcaatcatcatcatggtggcagtgggccttctggggttgataactgcaaatgaacttggatggctggaaagaacaaaaaatgacatagctcatctaatgggaaggagagaagaaggagtaactatgggattctcaatggacatcgatttgaggccggcctccgcctgggctatctatgctgcattgacaactctcatcaccccagccgtccaacatgcggtaaccacttcatataacaactactccttaatggcgatggccacacaagctggagtgctgtttggcatgggcaaagggatgccattttatgcatgggactttggagtcccgctgctaatgatgggttgctactcacaattaacacccctgaccctgatagtggctatcattctgcttgtggcacactacatgtacttgatcccaggcctacaggcagcagcagcgcgtgctgcccagaagagaacagcagctggcatcatgaagaatcccgttgtggatggaatagtggtaactgacattgacacaatgacaattgacccccaagtggagaagaagatgggacaagtgttactcatagcagtagccatctccagtgctgtgctgctgcggactgcttggggatggggggaagctggagctctgatcacagcagcaacctccactttgtgggaaggttctccaaacaaatactggaactcctctacagccacctcactgtgcaacatctttagaggaagttacctggcaggcgcttctcttatttacacagtgacaagaaatgctggcctggtcaagagacgtggaggtggaacgggagagactctaggagagaagtggaaagctcgcctgaatcagatgtcggccctggagttctactcttacaaaaagtcgggcatcactgaagtgtgtagagaggaggctcgccgcgccctcaaggatggagtggccacaggaggacatgctgtatcccggggaagcgcaaagctcagatggctggtggagagaggatacctgcagccccatggaaaggttgttgacctcggatgtggcagagggggttggagctattatgccgctaccatccggaaagtgcaggaggtgaaaggatacacaaagggaggtcccggtcatgaagaacccatgctggtgcaaagctatggatggaacatagttcgtctcaagagtggagtggacgtcttccacatggcggctgagccgtgtgatactctgctgtgtgacataggtgagtcatcatccagtcctgaagtagaagagacgcgaacactcagagtgctctctatggtgggggactggcttgaaaaaagaccaggggccttctgcataaaggtgctgtgcccatacaccagcactatgatggagaccatggagcgactgcaacgtaggtatgggggaggattagtcagagtgccattgtctcgcaactccacacatgagatgtattgggtctctggagcaaaaagcaacatcataaaaagtgtgtccaccacaagccagctcctcctgggacgcatggatgggcccaggaggccagtgaaatatgaggaggatgtgaacctcggctcgggcacacgagctgtggcaagctgtgctgaggctcccaacatgaagatcattggtaagcgcattgagagaatccgcagtgaacatgcagaaacatggttctttgatgaaaaccacccatacaggacatgggcttaccatgggagctacgaagcccccacgcaagggtcagcgtcttccctcgtgaatggggttgttaggctcctgtcaaagccctgggatgtagtgactggagttacaggaatagctatgactgacaccacaccatatggccaacaaagagtcttcaaagaaaaagtggacaccagggtgccagatccccaagaaggcactcgccagacaatgaacatggtctcgtcctggctgtggaaggagctgggaaaacgcaagcggccacgcgtctgcaccaaagaagagttcatcaacaaggtgcgcagcaatgcagcgctgggagcaatatttgaagaggaaaaagaatggaagacggccgtggaagctgtgaatgatccaaggttttgggccctagtggataaggagagagagcatcacctaagaggagagtgtcatagctgtgtgtacaacatgatgggaaaaagagagaagaagnaaggagaattcgggaaagcaaaaggcagccgcgccatctggtacatgtggttgggagccaggtttctggagtttgaatcactggggtttctgaatgaagatcactggatgggaagagagaactcaggaggtggtgtcgaagggctaggactgcaaagacttggatatattctagaagaaatgaatcgggcaccaggaggaaagatgtatgcagatgacaccgctggttgggatacccgcattagtaagtttgatctggagaatgaagccttgattaccaaccaaatggaggaagggcacagagctctggcgttggctgtgattaaatacacataccaaaacaaagtggtgaaggtccttagaccagctgaaggaggaaaaacagttatggacatcatttcaagacaagaccagagagggagtgggcaagttgtcacttatgctctcaacacgtttaccaacttagtggtgcagcttattcggaacatggaggctgaggaagtgttagagatgcaagacttatggctgttgaggaagccagagaaagtgactagatggttgcagagtaatggatgggacagactcaaacgaatggcagtcagtggagatgactgtgttgtgaagccaattgatgataggtttgcatgctgcctcaggttcctaaacgacatggggaaagttaggaaagacacacaggaatggaaaccctcgactggatggagcaattgggaagaagtccctttctgctcccaccacttcaacaagctgcacctcaaggatggtagatccattgtggtcccttgccgccaccaagatgaactgattggccgagcccgtgtatcaccaggggcaggatggagcatccgggagactgcctgtcttgcaaaatcatatgcacagatgtggcagcttctttacttccacagaagagaccttcgactgatggccaacgccatttgttcggctgtgccagtcgactgggtaccaaccgggagaaccacctggtcaatccacgggaagggagaatggatgaccactgaggacatgctcatggtgtggaatagagtgtggattgaggagaacgaccatatggaggacaagactcctgtaacaaagtggactgacattccctacctgggaaaaagggaggacttatggtgtggatcccttatagggcacagaccccgcaccacttgggctgagaacatcaaagacacagtcaacatggtgcgcaggatcataggtgatgaagaaaaatacatggactacctatccacccaagtccgctacttgggtgaggaagggtccacacctggagtgttgtaa

SEQ ID NO: 78 - DNA, 10272 bp, Zika virus
  Polyprotein gene, complete cds GenBank: EU545988.1
atgaaaaaccccaaagaagaaatccggaggatccggattgtcaatatgctaaaacgcggagtagcccgtgtgagcccctttgggggcttgaagaggctgccagccggacttctgctgggtcatgggcccatcaggatggtcttggcgatactagcctttttgagattcacggcaatcaagccatcactgggtctcatcaatagatggggttcagtggggaaaaaagaggctatggaaataataaagaagttcaagaaagatctggctgccatgctgagaataatcaatgctaggaaggagaagaagagacgaggcacagatactagtgtcggaattgttggcctcctgctgaccacagccatggcagtggaggtcactagacgtgggagtgcatactatatgtacttggacagaagcgatgctggggaggccatatcttttccaaccacactggggatgaacaagtgttacatacagatcatggatcttggacacatgtgtgatgccaccatgagctatgaatgccctatgttggatgagggggtagaaccagatgacgtcgattgttggtgcaacacgacatcaacttgggttgtgtacggaacctgccaccacaaaaaaggtgaagcacggagatctagaagagctgtgacgctcccctcccattccactaggaagctgcaaacgcggtcgcagacctggttggaatcaagagaatatacaaagcacctgattagagtcgaaaattggatattcaggaaccctggcttcgcgttagcagcagctgccatcgcctggcttttgggaagttcaacgagccaaaaagtcatatacttggtcatgatactgctgattgccccggcatacagcatcaggtgcataggagtcagcaatagggactttgtggaaggtatgtcaggtgggacttgggttgatgttgtcttggaacatggaggttgtgttaccgtaatggcacaggacaaaccggctgtcgacatagagctggttacaacaacagtcagcaacatggcggaggtaagatcctattgctatgaggcatcaatatcggacatggcttcggacagccgctgcccaacacaaggtgaagcctaccttgacaagcagtcagacactcaatatgtctgcaaaagaacgttagtggacagaggctggggaaatggatgtggactttttggcaaagggagcctggtgacatgcgctaagtttgcatgctccaagaaaatgaccgggaagagcatccagccagagaatctggagtaccggataatgctgtcagttcatggctcccagcacagtgggatgatcgttaatgacacaggacatgaaactgatgagaatagagcgaaggttgagataacgcccaattcaccaagagctgaagccaccctggggggttttggaagcctaggacttgattgtgaaccgaggacaggccttgacttttcagatttgtattacttgactatgaataacaagcactggttggttcacaaggagtggttccacgacattccattaccttggcatgctggggcagacaccggaactccacattggaacaacaaagaagcattggtagagttcaaggacgcacatgccaaaaggcaaactgtcgtggttctagggagtcaagaaggagcagttcacacggcccttgctggagctctggaggctgagatggatggtgcaaagggaaggctgtcctctggccacttgaaatgtcgcctgaaaatggataaacttagattgaagggcgtgtcatactccttgtgtaccgcagcgttcacattcaccaagatcccggctgaaacactgcacgggacagtcacagtggaggtacagtacgcagggacagatggaccctgcaaggttccagctcagatggcggtggacatgcaaactctgaccccagttgggaggctgataaccgctaaccctgtaatcactgaaagcactgagaactctaagatgatgctggaacttgatccaccatttggggactcttacattgtcataggagtcggggagaagaagatcacccatcactggcacaggagtggcagcaccattggaaaagcatttgaagccactgtgagaggtgccaagagaatggcagtcttgggagacacagcctgggattttggatcagttggaggtgctctcaactcattgggcaagggcatccatcaaatttttggagcagctttcaaatcattgtttggaggaatgtcctggttctcacaaattctcattggaacgttgctggtgtggttgggtctgaatacaaagaatggatctatttcccttacgtgcttggccttagggggagtgttgatctttttatccacagccgtctctgctgatgtggggtgctcggtggacttctcaaagaaggaaacgagatgcggtacgggggtgttcgtctataacgacgttgatgcctggagggacaggtacaagtaccatcctgactcccctcgtagattagcagcagcagtcaagcaagcctgggragatgggatctgtgggatctcctctgtttcaagaatggaaaacatcatgtggagatcagtagaaggggagctcaacgcaatcctggaagagaatggagttcaactgacggtcgttgtgggatctgtaaaaaaccccatgtggagaggtccacagagattgcccgtgcctgtgaacgagctgccccacggctggaaggcttgggggaaatcgtacttcgtcagagcagcaaagacaaataacagctttgtcgtggatggtgacacactgaaggaatgcccactcaaacatagagcatggaacagctttcttgtggaggatcatgggttcggggtatttcacactagtgtctggctcaaggttagagaagattattcattagagtgtgatccagccgttattggaacagctgctaagggaaaggaggctgtgcacagtgatctaggctactggattgagagtgagaagaatgacacatggaggctgaagagggcccacctgatcgagatgaaaacatgtgaatggccaaagtcccacacattgtggacagatggaatagaagaaagtgatctgatcatacccaagtctttagctgggccactcagccatcacaacaccagagagggctacaggactcaaatgaaagggccatggcacagtgaagagcttgaaattcggtttgaggaatgcccaggcactaaggtccacgtggaggaaacatgtggaacaagaggaccatctctgagatcaaccactgcaagcggaagggtgatcgaggaatggtgctgcagggaatgcacaatgcccccactgtcgttccgggctaaagatggctgttggtatggaatggagataaggcccaggaaagaaccagaaagtaacttagtaaggtcaatggtgactgcaggatcaactgatcacatggatcacttctcccttggagtgcttgtgattctgctcatggtgcaggaagggctgaagaagagaatgaccacaaagatcatcataagcacatcaatggcagtgctggtagctatgatcctgggaggattttcaatgagtgacctggccaagcttgcaattttgatgggtgccacctttgcggaaatgaacactggaggagatgtagctcatctggcgctgatagcggcattcaaagtcagacctgcgttgctggtatctttcatcttcagagctaattggacaccccgtgagagcatgctgctggccctggcttcgtgtcttctgcaaactgcgatctccgccttggaaggcgacctgatggttctcatcaatggttttgctttggcctggttggcaatacgagcgatggttgttccacgcactgacaacatcaccttggcaatcctgactgcgctgacaccactggcccggggcacgctgcttgtggcgtggagagcaggccttgctacttgcggggggttcatgcttctctctctgaaggggaagggcagtgtgaagaagaacctaccatttgtcatggccttgggactcaccgctgtgaggctggtcgaccccatcaacgtggtgggactgctgttgctcacaaggagtgggaagcggagctggccccctagtgaagtactcacagctgttggtctgatatgcgcgttggccggagggttcgccaaggcggatatagagatggctgggcccatggccgcggtcggtctgctaattgtcagttacgtggtctcaggaaagagtgtggacatgtacattgaaagagcaggtgacatcacatgggaaaaagatgcggaagtcactggaaacagtccccggctcgatgtggcactggatgagagtggtgatttctccctagtggaggatgatggtccccccatgagagagatcatactcaaagtggtcctgatgaccatctgtggcatgaacccaatagccataccctttgcagctggagcgtggtacgtgtatgtgaagactggaaaaaggagtggtgctctatgggatgtgcctgctcccaaggaagtaaaaaagggggagaccacagatggagtgtacagagtaatgactcgtagactgcttggttcaacacaagttggagtgggagtcatgcaagagggggtcttccacactatgtggcacgtcacaaaaggatccgcgctgagaagcggtgaagggagacttgatccatactggggagatgtcaagcaggatctggtgtcatattgtggtccgtggaagctagacgccgcctgggacgggcacagcgaggtgcagctcttggccgtgccccccggagagagagcgaggaacatccagactccgcccggaatatttaagacaaaggatggggacattggagcagttgcgttggactacccagcaggaacttcaggatctccaatcctagacaagtgtgggagagtgataggactctatggtaatggggtcgtgataaaaaatgggagttatgttagtgccatcacccaagggaggagggaggaagagactcctgttgagtgcttcgagccttcgatgttgaagaagaagcagctaactgtcttagacctgcatcctggagctgggaaaaccaggagagttcttcctgaaatagtccgtgaagccataaaaacaagactccgtactgtgatcttagctccaaccagggttgtcgctgctgaaatggaggaagcccttagagggcttccagtgcgttatatgacaacagcagtcaatgtcacccattctgggacagaaattgttgacttaatgtgccatgccaccttcacttcacgtctactacaaccaatcagagtccccaactataatctgtatattatggacgaggcccacttcacagatccctcaagtatagcagcaagaggatacatttcaacaagggttgagatgggcgaggcggccgccatcttcatgaccgccaccccaccaggaacccgtgacgcattcccggactccaactcaccaattatggacaccgaagtggaagtcccagagagagcctggagctcaggctttgattgggtgacggatcattctggaaaaacagtttggtttgttccaagcgtgaggaacggcaatgagatcgcagcttgtctgacaaaggctggaaaacgggtcatacagctcagcagaaagacttttgagacagagttcctgaaaacaaaaaatcaagagtgggacttcgtcgtgacaactgacatttcagagatgggcgccaactttaaagctgaccgtgtcatagattccaggagatgcctaaagccggtcatacttgatggcgagagagtcattctggctggacccatgcctgtcacacatgccagcgctgcccagaggagggggcgcataggcaggaatcccaacaaacctggagatgagtatctgtatggaggtgggtgcgcagagactgatgaagaccatgcacactggcttgaagcaagaatgcttcttgacaacatttacctccaagatggcctcatagcctcgctctatcgacctgaggccgacaaagtagcagctattgagggagagttcaagcttaggacggagcaaaggaagacctttgtggaactcatgaaaagaggagatcttcctgtttggctggcctatcaggttgcatctgccggaataacctacacagatagaaaatggtgctttgatggcacgaccaacaacaccataatggaagacagtgtgccggcagaggtgtggaccagatacggagagaaaagagtgctcaaaccaaggtggatggacgccagagtttgttcagatcatgcggccctgaagtcattcaaagagtttgccgctgggaaaagaggagyggcctttggagtgatggaagccctgggaacattgccgggacacatgacagagagattccaggaagccattgacaacctcgctgtgctcatgcgggcagagactggaagcaggccttacgaagccgcggcggcccaattgccggagaccttagagaccatcatgcttttggggttgctgggaacagtctcgctgggaatctttttcgtcttgatgcggaataagggcatcgggaagatgggctttggaatggtgactcttggggccagcgcatggcttatgtggctctcggaaattgagccagccagaattgcatgtgtcctcattgttgtgttcctattgctggtggtgctcatacctgagccagaaaagcaaagatctccccaggacaaccaaatggcaatcatcatcatgatagcagtgggtcttctgggtttgattaccgccaatgaacttggatggttggaaagaacaaagagtgacctaagccatctaatgggaaggagagaggagggggcaaccataggattctcaatggacattgacctgcggccagcctcagcttgggctatctatgctgctctgacaactttcatcaccccagccgtccaacatgcggtgaccacttcatacaacaactactccttaatggcgatggccacgcaagctggagtgttgtttggtatgggtaaagggatgccattctacgcatgggactttggagtcccgctgctaatgatgggttgctactcacaattaacacccctgaccctaatagtggccatcattttgctcgtggcgcactacatgtacttgatcccagggctgcaggcagcagctgcgcgtgctgcccagaagagaacggcagctggcatcatgaagaaccctgttgtggatggaatagtggtgactgacattgacacaatgacaattgaccaccgagtggagaaaaagatgggacaggtgctactcatagcagtagccgtctccagcgccatactgtcgcggaccgcctgggggtggggggaggctggggccctgatcacagctgcaacttccactttgtgggaaggctctccgaacaagtactggaactcctccacagccacttcactgtgtaacatttttaggggaagttacttggctggagcttctctaatctacacagtaacaagaaacgctggcttggtcaagagacgtgggggtggaacgggagagaccctgggagagaaatggaaggcccgcctgaaccagatgtcggccctagagttctactcctacaaaaagtcaggcatcaccgaggtgtgcagagaagaggcccgccgcgccctcaaggacggtgtggcaacaggaggccatgctgtgtcccgaggaagtgcaaagcttagatggttggtggagagaggatacctgcagccctatggaaaggtcattgatcttggatgtggcagagggggctggagttactacgccgccaccatccgcaaagttcaagaagtgaaaggatacacaaaaggaggccctggtcatgaagaacccatgttggtgcaaagctatgggtggaacatagtccgtcttaagagtggggtggacgtctttcatatggcggctgagccgtgtgacactttgctgtgtgatataggtgagtcatcatctagtcctgaagtggaagaagcacggacgctcagagtcctttccatggtgggggattggcttgaaaaaagaccaggagccttttgtataaaagtgttgtgcccatacaccagcactatgatggaaaccctggagcgactgcagcgtaggtatgggggaggactggtcagagtgccactctcccgcaactctacacatgagatgtactgggtctctggagcgaaaagcaacaccataaaaagtgtgtccaccacgagccagctcctcttggggcgcatggacgggcccaggaggccagtgaaatatgaggaggatgtgaatctcggctccggcacgcgggctgtggtaagctgcgctgaagctcccaacatgaagatcattggtaaccgcattgagaggatccgcagtgagcacgcggaaacgtggttctttgacgagaaccacccatataggacatgggcttaccatggaagctatgaggcccctacacaagggtcagcgtcctctctaataaacggggttgtcaggctcctgtcaaaaccctgggatgtggtgactggagtcacaggaatagccatgaccgacaccacaccgtatggtcagcaaagagttttcaaggaaaaagtggacactagggtgccagacccccaagaaggcactcgtcaggttatgagcatggtctcttcctggttatggaaagagctaggcaaacacaaacggccacgagtctgtaccaaagaagagttcatcaacaaggttcgtagcaatgcagcattaggggcaatatttgaagaggaaaaagagtggaagactgcagtggaagctgtgaacgatccaaggttctgggctctagtggacaaggaaagagagcaccacctgagaggagagtgtcagagctgtgtgtacaacatgatgggaaaaagagaaaagaaacaaggggaatttggaaaggccaagggcagccgcgccatctggtatatgtggctaggggctagattcctggagttcgaagcccttggattcttgaacgaggatcactggatggggagagagaattcaggaggtggtgttgaagggctgggattacaaagactcggatatgtcctagaagagatgagtcgcataccaggaggaaggatgtatgctgatgacacagctggctgggacacccgcatcagcaggtttgatctggagaatgaagctctaatcaccaaccaaatggagaaagggcacagggccttggcattggccataatcaagtacacataccaaaacaaagtggtaaaggtcctcagaccagctgaaaaagggaagacagttatggacattatttcaagacaagaccaaagggggagcggacaagttgtcacttacgctcttaatacattcaccaacctggtggtgcagctcattcggaatatggaggctgaggaagttctagagatgcaagacttgtggctgctgcggaggtcagagaaagtgaccaactggttgcagagcaacggatgggataggctcaaacgaatggcagtcagtggagatgattgcgttgtgaaaccaattgatgataggtttgcacatgccctcaggttcttgaatgatatgggaaaagtcaggaaggacacacaagagtggaaaccctcaactggatgggacaattgggaagaagttccgttttgctcccaccacttcaacaagctccatctcaaggacgggaggtccattgtggttccctgccgccaccaagatgaactgattggccgagcccgcgtctcaccaggggcgggatggagcatccgggagactgcttgcctagcaaaatcatatgcgcaaatgtggcagctcctttatttccacagaagggacctccgactgatggccaatgccatttgttcatctgtgccagttgactgggttccaactgggagaactacctggtcaatccatggaaagggagaatggatgaccactgaagacatgcttgtggtgtggaacagagtgtggattgaggagaacgaccacatggaagacaagaccccagttacgaaatggacagacattccctatttgggaaaaagggaagacttgtggtgtggatctctcatagggcacagaccgcgcactacctgggctgagaacatcaaaaacacagtcaacatgatgcgcaggatcataggtgatgaagaaaagtacatggactacctatccacccaagttcgctacttgggtgaagaagggtccacacccggagtgttgtaa

SEQ ID NO: 79 - DNA, 10807 bp, Zika virus
  Isolate Zika virus/H.sapiens-tc/PHL/2012/CPC-0740, complete genome
agttgttgatctgtgtgaatcagactgcgacagttcgagtttgaagcgaaagctagcaacagtatcaacaggttttattttggatttggaaacgagagtttctggtcatgaaaaacccaaaaaagaaatccggaggattccggattgtcaatatgctaaaacgcggagtagcccgtgtgagcccctttgggggcttgaagaggctgccagccggacttctgctgggccatgggcccatcaggatggtcttggcgatactagcctttttgagattcacggcaatcaagccatcactgggtctcatcaatagatggggttcagtggggaaaaaagaggctatggaaataataaagaagttcaagaaagatctggctgccatgctgagaataatcaatgctaggaaggagaagaagagacgaggcgcagatactagcgtcggaattgttggcctcctcctgaccacagccatggcagtagaggtcactagacgtgggagtgcatactatatgtacttggacagaagcgatgctggggaggccatatcttttccaaccacactggggatgaataagtgttacatacaaatcatggatcttggacacatgtgtgatgccaccatgagctatgaatgccctatgttggatgagggggtagaaccagatgacgtcgattgctggtgcaacacgacatcaacttgggttgtgtatggaacctgccaccacaaaaaaggtgaagcacggagatctagaagagctgtgacgctcccctcccattccactaggaagctgcaaacgcggtcgcagacctggttggaatcaagagaatacacaaagcacctgattagagttgaaaattggatattcaggaaccctggcttcgcgttagcagcagctgtcatcgcttggcttttgggaagttcaacgagccaaaaagtcatatatctggtcatgatactgctgattgccccggcatacagcatcaggtgcataggagtcagcaatagggactttgtggaaggtatgtcaggtgggacttgggttgatgttgtcttggaacatggaggttgtgttaccgtaatggcacaggacaaaccgactgtcgacatagagctggttacaacaacagtcagcaacatggcggaggtaagatcctactgctatgaggcatcaatatcggatatggcttcggacagccgctgcccaacacaaggtgaggcctaccttgacaagcagtcagacactcaatatgtctgcaaaagaacgttagtggacagaggctggggaaatggatgtggactttttggcaaagggagcctggtgacatgcgctaagtttgcatgctccaagaaaatgaccgggaagagcatccagccagagaatctggagtaccggataatgctgtcagttcatggctcccagcacagtgggatgatcgttaatgacacaggacatgaaactgatgagaatagagcgaaggttgagataacgcccaattcaccaagagccgaagccaccctggggggttttgggagcctaggacttgattgtgaaccgaggacaggccttgacttttcagatttgtattacctgactatgaataacaagcactggttggttcacaaggagtggttccacgacattccattaccttggcatgctggggcagacactggaactccacattggaacaacaaagaagcactggtagagttcaaggacgcacatgcaaaaaggcaaactgtcgtggttctagggagtcaagaaggagcagttcacacggcccttgctggagctctggaggctgagatggatggagccaagggaaggctgtcctctggccacttgaaatgtcgcctgaaaatggataaacttagattgaagggcgtgtcatactccttgtgcactgcagcgttcacattcaccaagatcccggctgaaacactgcacgggacagtcacagtggaggtacagtacgcagggacagatggaccttgcaaggttccagctcagatggcggtggatatgcaaactctgaccccagttgggaggttgataaccgctaaccctgtaatcactgaaagcaccgagaactctaagatgatgctggaacttgatccaccatttggggactcttacattgtcataggagtcggggagaagaagatcacccatcactggcacaggagtggcagcaccattggaaaagcatttgaagccactgtgagaggtgccaagagaatggcagtcttgggagacacagcctgggactttggatcagttgggggtgctctcaactcattgggcaagggcatccatcaaatttttggagcagctttcaaatcattgttcggaggaatgtcctggttctcacaaattctcattggaacgttgctggtgtggttgggtctgaatacaaagaatggatctatttcccttacgtgcttggccttagggggagtgttgatcttcttatccacagccgtttctgctgatgtggggtgctcggtggacttctcaaagaaggaaacgagatgcggtacaggggtgttcgtctataacgacgttgaagcctggagggacaggtacaagtaccatcctgactcccctcgtagattggcagcagcagtcaagcaagcctgggaagatgggatctgtgggatctcctctgtctcaagaatggaaaacatcatgtggagatcagtagaaggggagctcaacgcaatcctggaagagaatggagttcaactgacggtcgttgtgggatctgtaaaaaaccccatgtggagaggtccacagagattgcccgtgcctgtgaacgagctgccccacggctggaaggcttgggggaaatcgtacttcgtcagagcagcaaagacaaataacagctttgtcgtggatggtgacacactgaaggaatgcccactcaaacatagagcatggaacagctttcttgtggaggatcatgggtttggggtatttcacactagtgtctggctcaaggttagagaagattattcattagagtgtgatccagccgtcattggaacagctgctaagggaaaggaggctgtgcacagcgatctaggctactggattgagagtgagaagaacgacacatggaggctgaagagggcccacctgatcgagatgaaaacatgtgaatggccaaagtcccacacattgtggacagatggagtagaagaaagtgatctgatcatacccaagtctttagctgggccactcagccatcacaacaccagagagggctacaggactcaaatgaaagggccatggcacagtgaagagcttgaaattcggtttgaggaatgcccaggcactaaggtccacgtggaggaaacatgtgggacaagaggaccatccctgagatcaaccactgcaagcggaagggtgatcgaggaatggtgctgcagggaatgcacaatgcccccactgtcgttccgagctaaagatggctgttggtatggaatggagataaggcccaggaaagaaccagaaagtaacttagtaaggtcaatggtgactgcaggatcaactgatcacatggatcacttctctcttggagtgcttgtgattttgctcatggtgcaggaagggctgaagaagagaatgaccacaaagatcatcataagcacatcaatggcagtgctggtagccatgatcctgggaggattttcaatgagtgacctggctaagcttgcaattttgatgggtgccaccttcgcggaaatgaacactggaggagatgtagctcatttggcgctgatagcggcattcaaagtcagacctgcgttgctggtatctttcatcttcagagctaattggacaccccgtgagagcatgctgctggccttggcctcgtgtcttctgcaaactgcgatctccgccttggaaggcgacctgatggttctcatcaatggttttgctttggcctggttggcaatacgagcgatggttgttccacgcactgacaacatcaccttggcaatcctggctgctctgacaccactggcccggggcacactgcttgtggcgtggagagcaggccttgctacttgcggggggttcatgctcctctctctgaaggggaaaggcagtgtgaagaagaacctaccatttgtcatggccttgggactaactgctgtgaggctggtcgaccccatcaacgtggtgggactgctgttgctcacaaggagtgggaagcggagctggccccctagtgaagtactcacagctgttggcctgatatgcgcattggctggagggttcgccaaggcggatatagagatggctgggcccatggccgcggtcggtctgctaattgtcagttacgtggtctcaggaaagagtgtggacatgtacattgaaagagcaggtgacatcacatgggaaaaagatgcggaaatcactggaaacagtccccggctcgatgtggcactagatgagagtggtgatttctccctagtggaggatgatggtccacccatgagagagatcatactcaaagtggtcctgatgaccatctgcggcatgaacccaatagccataccctttgcagctggagcgtggtacgtgtatgtgaagactggaaaaaggagtggtgctctatgggatgtgcctgctcccaaggaagtaaaaaagggggagaccacagatggagtgtacagagtaatgactcgtagactgcttggttcaacacaagttggagtgggagtcatgcaagagggggtcttccacactatgtggcacgtcacaaaaggatccgcgctgagaagcggtgaagggagacttgatccatactggggagatgtcaagcaggatctggtgtcatactgtggtccgtggaagctagacgccgcctgggacgggcacagcgaggtgcagctcttggccgtgccccccggagagagagcgaggaacatccagactctgcccggaacatttaagacaaaggatggggacattggagcagttgcgctggactacccagcaggaacttcaggatctccaatcctagacaagtgtgggagagtgataggactctatggtaatggggtcgtgataaaaaatgggagttatgttagtgccatcacccaagggaggagggaggaagagactcctgttgagtgcttcgagccttcgatgctgaagaagaagcagctaactgtcttagacctgcatcctggagccgggaaaaccaggagagttcttcctgaaatagtccgtgaagccataaaaacaagactccgtactgtgatcttagctccaaccagggtcgtcgctgctgaaatggaggaagcccttagagggcttccagttcgttatatgacaacagcagtcaatgtcacccattctgggacagaaatcgttgacttaatgtgccatgctaccttcacttcacgcctactacaaccaatcagagtccccaactataatttgtatattatggatgaggcccacttcacagatccctcaagtatagcagcaagaggatacatttcaacaagggttgagatgggcgaggcggctgccatcttcatgaccgccacgccaccaggaacccgtgacgcattcccggactccaactcaccaattatggacaccgaggtggaagtcccagagagagcctggagcacaggctttgattgggtgacggatcattctgggaaaacagtctggtttgttccaagcgtgaggaacggcaatgagatcgcagcttgtctgacaaaggctggaaaacgggtcatacagctcagcagaaagacttttgagacagagttccagaaaacgaaaaatcaagagtgggacttcgtcgtgacaaccgacatttcagagatgggcgccaactttaaagctgaccgtgtcatagattccaggagatgcttaaagccggtcatacttgatggcgagagagtcattttggctggacccatgcctgtcacacatgccagcgctgctcagaggagggggcgcataggcaggaatcccaacaaacctggagatgagtatctgtatggaggtgggtgcgcagagactgatgaagatcacgcacactggcttgaagcaagaatgcttcttgacaacatttacctccaagatggcctcatagcttcgctctatcgacctgaggccgacaaagtagcagctattgagggagagttcaagcttaggacggagcaaaggaagacctttgtggaactcatgaaaagaggagatcttccggtttggttggcctatcaggttgcatctgccggaataacctacacagatagaagatggtgctttgatggcatgaccaacaacaccataatggaagacagtgtgccggcagaggtgtggaccagatacggagagaaaagagtgctcaaaccgaggtggatggacgccagagtttgttcagatcatgcggccctgaagtcattcaaagagtttgccgctgggaaaagaggagcggcctttggagtgatagaagccctgggaacactgccaggacacatgacagagagattccaggaagccattgacaacctcgctgtgctcatgcgggcagagactggaagcaggccttacaaagccgcggcggcccaattgccggagaccctagagaccattatgcttttggggttgctgggaacagtctcgctgggaatctttttcgtcttgatgcggaacaagggcatggggaagatgggctttggaatggtgactcttggggccagcgcatggcttatgtggctctcggaaattgagccagccagaattgcatgtgtcctcattgtcgtgttcctattgctggtggtgctcatacctgagccagaaaagcaaagatctcctcaggacaaccaaatggcaatcatcatcatggtagcagtgggtcttctgggcttgattaccgccaatgaactcggatggttggagagaacaaaaagtgacctaagccatctaatgggaaggagagaggagggggcaaccacaggattctcaatggacattgacctgcggccagcctcagcttgggctatctatgctgctctgacaactttcatcaccccagccgtccaacatgcggtgaccacttcatacaacaactactccttaatggcgatggccacgcaagctggggtgttgtttggtatgggcaaagggatgccattctacgcatgggactttggagtcccgctgctaatgatgggttgctactcacaattaacacctctgaccctaatagtggccatcattttgctcgtggcgcactacatgtacttgatcccagggctgcaggcagcagctgcgcgggctgcccagaagagaacggcagctggcatcatgaagaaccctgttgtggatggaatagtggtgactgacattgacacaatgacaattgacccccaagtggaaaaaaagatggggcaggtgctactcatagcagtagccgtctccagcgccatactgtcgcggaccgcctgggggtggggggaggctggggccctgatcacagctgcaacttccaccttgtgggaaggctctccgaacaagtactggaactcctccacagccacttcactgtgtaacatttttaggggaagttacttggctggagcttctctaatctacacagtaacaagaaacgctggcttggtcaagagacgtgggggtggaacgggagagaccctgggagagaaatggaaggcccgcctgaaccagatgtcggccctggagttctactcctacaaaaagtcaggcatcaccgaggtgtgcagagaagaggcccgccgtgccctcaaggacggtgtggcaacaggaggccatgctgtgtcccgaggaagtgcaaagcttagatggctggtggagagaggatacctgcagccctatggaaaggtcattgatcttggatgtggcagagggggctggagttactatgccgccaccatccgcaaagttcaggaagtgaaaggatacacaaaaggaggccctggtcatgaagaacccatgttggtgcaaagctatgggtggaacatagtccgtcttaagagtggggtggacgtctttcacatggcggctgagccgtgtgacactttgctgtgtgatataggtgagtcatcatctagtcctgaagtggaagaagcacggacgctcagagtcctctccatggtgggggattggcttgaaaaaagaccaggagccttttgtataaaagtgttgtgcccatacaccagcactatgatggaaaccctggagcgactgcagcgtaggtatgggggaggactggtcagggtgccactctcccgcaactctacacatgagatgtactgggtctctggagcgaaaagcaacaccataaaaagtgtgtccaccacgagccagctcctcttggggcgcatggacgggcccaggaggccagtgaaatatgaggaggatgtgaatctcggctctggcacgcgggctgtggtaagctgcgctgaagctcccaacatgaagatcattggtaaccgcattgagaggatccgcagtgagcacgcggaaacgtggttctttgacgagaaccacccatataggacatgggcttaccatggaagctatgaggcccctacacaagggtcagcgtcctctctaataaacggggttgtcaggctcctgtcaaaaccctgggatgtggtgactggagtcacaggaatagccatgactgacaccacaccgtatggtcagcaaagagttttcaaggaaaaagtggacactagggtgccagacccccaagaaggcactcgtcaggttatgagcatggtctcttcctggttatggaaggagctaggcaaacacaaacggccacgagtctgtaccaaagaagagttcatcaacaaggttcgtagcaatgcagcattaggggcaatatttgaagaggaaaaagagtggaagactgcagtggaagctgtgaatgatccaaggttctgggctctagtggacaaggaaagagagcatcacctgagaggagagtgtcagagctgtgtgtacaacatgatgggaaaaagagaaaagaaacaaggggaatttggaaaggccaagggcagccgcgccatctggtatatgtggctaggggctagattcctagagttcgaagcccttggattcttgaatgaggatcattggatggggagagagaattcaggaggtggtgttgaaggactgggattacaaagactcggatatgtcctagaagagatgagtcgcataccaggaggaaggatgtatgcagatgatactgctggctgggacacccgcatcagcaggtttgatctggagaatgaagctctaatcaccaaccaaatggagaaagggcacagggccttggcattggccataatcaagtacacataccaaaacaaagtggtaaaggtccttagaccagctgaaaaagggaagacagttatggacattatttcaagacaagaccaaagggggagcggacaagttgtcacttacgctcttaatacattcaccaacctggtggtgcagctcattcggaatatggaggctgaggaagttctagagatgcaagacttgtggctgctgcggaggccagagaaagtgaccaactggttgcaaagcaacggatgggataggctcaaaagaatggcagtcagtggagatgattgcgttgtgaaaccaattgatgataggtttgcacatgccctcaggttcttgaatgatatgggaaaagttaggaaggacacacaagagtggaaaccctcaactggatgggacaactgggaagaagttccgttttgctcccaccacttcaacaaactccatcttaaggacgggaggtccattgtggttccctgccgccaccaagatgaactgattggccgagcccgcgtatcaccaggggcgggatggagcatccgggagactgcttgcctagcaaaatcatatgcgcaaatgtggcagctcctttatttccacagaagggacctccgactgatggccaatgccatttgttcatctgtgccagttgattgggttccaactgggagaactacctggtcaatccatggaaagggagaatggatgaccactgaagacatgcttgtggtatggaacagagtgtggattgaggaaaacgaccacatggaagacaagaccccagttacaaaatggacagacattccctatttgggaaaaagagaagacttgtggtgtggatctctcatagggcacagaccgcgtactacctgggctgagaacatcaaaaatacagtcaacatgatgcgcaggatcataggtgatgaagaaaagtacatggactacctatccacccaggttcgctacttgggtgaagaagggtccacacctggagtgctgtaagcaccaatcttagtgttgtcaggcctgctagtcagccacagcttggggaaagctgtgcagcctgtgacccccccaggagaagctgggaaaccaagcctatagtcaggccgagaacgccatggcacggaagaagccatgctgcctgtgagcccctcagaggacactgagtcaaaaaaccccacgcgcttggaggcgcaggatgggaaaagaaggtggcgaccttccccacccttcaatctggggcctgaactggagatcagctgtggatctccagaagagggactagtggttagaggagaccccccggaaaacgcaaaacagcatattgacgctgggaaagaccagagactccatgagtttccaccacgctggccgccaggcacagatcgccgaatagcggcggccggtgtggggaaatccatgggtct

SEQ ID NO: 80 - DNA, 10807 bp, Zika virus
  Isolate Zika virus/H.sapiens-tc/THA/2014/SV0127- 14, complete genome
agttgttgatctgtgtgaatcagactgcgacagttcgagtttgaagcgaaagctagcaacagtatcaacaggttttattttggatttggaaacgagagtttctggtcatgaaaaacccaaaaaagaaatccggaggattccggattgtcaatatgctaaaacgcggagtagcccgtgtgagcccctttgggggcttgaagaggctgccagccggacttctgctgggtcatgggcccatcaggatggtcttggcgattctagcctttttgagattcacggcaatcaagccatcactgggtctcatcaatagatggggttcagtgggaaaaaaagaggctatggaaataataaagaagttcaagaaagatctggctgccatgctgagaataatcaatgctaggaaggagaagaagagacgaggcacagatactagtgtcggaattgttggcctcctgctgaccacagctatggcagcggaggtcactagacgtgggagtgcatactatatgtacttggacagaagcgatgctggggaggccatatcttttccaaccacactggggatgaataagtgttatatacagatcatggatcttggacacatgtgtgatgccaccatgagctatgaatgccctatgctggatgagggggtagaaccagatgacgtcgattgttggtgcaacacgacgtcaacttgggttgtgtacggaacctgccatcacaaaaaaggtgaagcacggagatccagaagagctgtgacgctcccctcccattccactaggaagctgcaaacgcggtcgcagacctggttggaatcaagagaatacacaaagcacttgattagagtcgaaaattggatattcaggaaccctggcttcgcgttagcagcagctgccatcgcttggcttttgggaagctcaacgagccaaaaagtcatatacttggtcatgatactgctgattgccccggcatacagcatcaggtgcataggagtcagtaatagggactttgtggaaggtatgtcaggtgggacttgggttgatgttgtcttggaacatggaggttgtgtcaccgtaatggcacaggacaaaccgactgtcgacatagagctggttacaacaacagtcagcaacatggcggaggtaagatcctactgctatgaggcatcaatatcggacatggcttcggacagccgctgcccaacacaaggtgaagcctaccttgacaagcaatcagacactcaatatgtctgcaaaagaacgttagtggacagaggctggggaaatggatgtggactttttggcaaagggagcctggtgacatgcgctaagtttgcatgctccaagaaaatgaccgggaagagcatccagccagagaatctggagtaccggataatgctgtcagttcatggctcccagcacagtgggatgatcgttaatgacacaggacatgaaactgatgagaatagagcgaaggttgagataacgcccaattcaccaagagccgaagccaccctggggggttttggaagcctaggacttgattgtgaaccgaggacaggccttgacttttcagatttgtattacttgactatgaacaacaagcactggttggttcacaaggagtggttccacgacattccattaccttggcacactggggcagacaccggaactccacactggaacaacaaagaagcactggtagagttcaaggacgcacatgccaaaaggcaaactgtcgtggttctagggagtcaagaaggagcagttcacacggcccttgctggagctctggaggctgagatggatggtgcaaagggaaggctgtcctctggccacttgaaatgtcgcctgaaaatggataaacttagattgaagggcgtgtcatactccttgtgtaccgcagcgttcacattcaccaagatcccggctgaaacactgcacgggacagtcacagtggaggtacagtacgcagggacagatggaccttgcaaggttccagctcagatggcggtggacatgcaaactctgaccccagttgggaggttgataaccgctaaccccgtaatcactgaaggcactgagaactctaagatgatgctggaacttgatccaccatttggggactcttacattgtcataggagtcggggagaagaagatcacccaccactggcacaggagtggcagcaccattggaaaagcatttgaagccactgtgagaggtgccaagagaatggcagtcttgggagacacagcctgggactttggatcagttggaggcgttcttaactcattgggcaagggcatccatcaaatttttggagcagctttcaaatcattgtttggaggaatgtcctggttctcacaaattctcattggaacgttgctgatgtggttgggtctgaatacaaagaatggatctatttcccttatgtgcttggccttagggggagtgttgatcttcttatccacagccgtctccgctgatgtggggtgctcggtggacttctcaaagaaggaaacgagatgcggtacaggggtgttcgtctataacgacgttgaagcctggagggacaggtacaagtaccatcctgactcccctcgtagattggcagcagtagtcaagcaagcctgggaagatggtatctgtgggatctcctctgtttcaagaatggaaaacatcatgtggagatcagtagaaggggagctcaacgcaatcctggaagagaatggagttcaactgacggtcgttgtgggatctgtaaaaaaccccatgtggagaggtccacagagattgcccgtgcctgtgaacgagctgccccacggctggaaggcttgggggaaatcgtacttcgtcagagcagcaaagacaaataacagctttgtcgtggatggtgacacactgaaggaatgcccactcaaacatagagcatggaacagctttcttgtggaggatcatgggttcggggtatttcacactagtgtctggctcaaggttagagaagattattcactagagtgtgatccagccgtcattggaacagctgttaagggaaaggaggctgtacacagtgatctaggctactggattgagagtgagaagaacgacacatggaggctgaggagggcccacctgatcgagatgaaaacatgtgaatggccaaagtcccacacattgtggacagatggaatagaagagagtgatctgatcatacccaagtctttagctgggccactcagccatcacaacaccagagagggctacaggacccaaatgaaagggccatggcacagtgaagagcttgaaattcggtttgaggaatgcccaggcactaaggtccacgtggaggaaacatgtggaacaagaggaccatctctgagatcaaccactgcaagcggaagggtgatcgaggaatggtgctgcagggagtgcacaatgcccccactgtcgttccgggctaaagatggctgttggtatggaatggagataaggcccaggaaagaaccagaaagtaacttagtaaggtcaatggtgactgcaggatcaactgatcacatggatcacttttcccttggagtgcttgtgattctgctcatggtgcaggaagggctgaagaagagaatgaccacaaagatcatcataagcacatcaatggcagtgctggtagctatgatcctgggaggattttcaatgagtgatctggctaagcttgcaattttgatgggtgccacctttgcggaaatgaacactggaggagatgtagctcatctggcgctggtagcggcattcaaagtcagaccagcgttgctggtatctttcatcttcagagctaattggacaccccgtgaaagcatgctgctggccttggcctcgtgtcttttgcaaactgcgatctccgccttggaaggcgacctgatggttctcatcaatggttttgctttggcctggttggcaatacgagcgatggttgttccacgcactgacaatatcaccttggcaatcctggctgctctgacaccactggcccggggcacactgcttgtggcgtggagagcaggccttgctacttgcggggggttcatgctcctctctctgaaggggaaaggcagtgtgaagaagaacttaccatttgtcatggccctgggactaaccgctgtgaggctggtcgaccccatcaacgtggtgggactgctgttgctcacaaggagtgggaagcggagctggccccctagcgaagtactcacagctgttggcctgatatgcgcattggctggagggttcgccaaggcagatatagagatggctgggcccatggccgcggtcggtctgctaattgtcagttacgtggtctcaggaaagagtgtggacatgtacattgaaagagcaggtgacatcacatgggaaaaagatgcggaagttactggaaacagtccccggctcgatgtggcactagatgagagtggtgatttctccctggtggaggatgacggtccccccatgagagagatcatactcaaagtggtcctgatgaccatctgtggcatgaacccaatagccataccctttgcagctggagcgtggtacgtatacgtgaaaactggaaaaaggagtggtgctctatgggatgtgcctgctcccaaggaagtaaaaaagggggagaccacagatggagtgtacagagtaatgactcgtagactgctaggttcaacacaagttggagtgggagttatgcaagagggggtctttcacactatgtggcatgtcacaaaaggatccgcgctgagaagcggtgaagggagacttgatccatactggggagatgtcaagcaggatctggtgtcatactgtggtccatggaagctagatgccgcctgggacgggcacagcgaggtgcagctcttggccgtgccccccggagagagagcgaggaacatccagactctgcccggaatatttaagacaaaggatggggacattggagcggttgcgctggactatccagcaggaacttcaggatctccaatcctagacaagtgtgggagagtgataggactctatggcaatggggtcgtgatcaagaatgggagttatgtcagtgccatcacccaagggaggagggaggaagagactcctgttgagtgcttcgagccttcgatgctgaagaagaagcagctaactgtcttagacttgcatcctggagctgggaaaaccaggagagttcttcctgaaatagtccgtgaagccataaaaacgagactccgtactgtgatcttagctccaaccagggttgtcgctgctgaaatggaggaagcccttagagggcttccagtgcgttatatgacaacagcagtcaatgtcacccattctgggacagaaatcgttgacttaatgtgccatgccaccttcacttcacgtctactacagccaatcagagtccccaactataatctgtatattatggatgaggcccacttcacagatccctcaagtatagcagcaagaggatacatttcaacaagggttgagatgggcgaggcagctgccatcttcatgaccgccacgccaccaggaacccgtgacgcattcccggactccaactcaccaattatggacaccgaagtggaagtcccagagagagcctggagctcaggctttgattgggtgacggatcattctggaaaaacagtttggtttgtcccaagcgtgaggaacggcaatgagatcgcagcttgtctgacaaaggctggaaaacgggtcatacagctcagcagaaagacttttgagacagagttccagaaaacaaaacatcaagagtgggacttcgtcgtgacaactgacatttcagagatgggcgccaactttaaagctgaccgtgtcatagattccaggagatgcctaaagccggtcatacttgatggcgagagagtcattctggctggacccatgcctgtcacacatgccagcgctgcccagaggagggggcgcataggcaggaatcccaacaaacctggagatgagtatctgtatggaggtgggtgcgcagagactgatgaagaccatgcacactggcttgaagcaagaatgctccttgacaatatttacctccaagatggcctcatagcctcgctctatcgacctgaggccgacaaagtagcagccattgagggagagttcaagcttaggacggagcaaaggaagacctttgtggaactcatgaaaagaggagatcttcctgtttggctggcctatcaggttgcatctgccggaataacctacacagatagaagatggtgctttgatggcatgaccaacaacaccataatggaagacagtgtgccggcagaggtgtggaccagacacggagagaaaagagtgctcaaaccgaggtggatggacgccagagtttgttcagatcatgcggccctgaagtcattcaaggagtttgccgctgggaaaagaggagcggcttttggagtgatggaagccctgggaacactgccaggacacatgacggagagattccaggaagccattgacaacctcgctgtgctcatgcgggcagagactggaagcaggccttacaaagccgcggcggcccaattgccggagaccctagagaccattatgcttttggggttgctgggaacagtctcgctgggaatctttttcgtcttgatgcggaacaagggcatagggaagatgggctttggaatggtgactcttggggccagcgcatggctcatgtggctctcggaaattgagccagccagaattgcatgcgtcctcattgttgtgttcctattgctggtggtgctcatacctgagccagaaaagcaaagatccccccaggacaaccaaatggcaatcatcatcatggtagcagtaggtcttctgggcttgattaccgccaatgaactcggatggttggagagaacaaagagtgacctaagccatctaatgggaaggagagaggagggggcaaccataggattctcaatggacattgacctgcggccagcctcggcctgggccatctatgctgccctgacaactttcattaccccagccgtccaacatgcagtgaccacttcatacaacaactactccttaatggcgatggccacgcaagctggagtgttgtttggtatgggcaaagggatgccattctacgcatgggactttggagtcccgctgctaatgataggttgctactcacaattaacacccctgaccctaatagtggctatcattttgctcgtggcgcactacatgtacttgatcccagggctgcaggcagcagctgcgcgtgctgcccagaagagaacggcagctggcatcatgaagaaccctgttgtggatggaatagtggtgactgacattgacacaatgactattgacccccaagtggagaaaaagatgggacaggtgctactcatagcagtagccgtctccagcgccatactgtcgcggaccgcctgggggtggggggaagctggggccctgatcacagctgcaacttccactttgtgggaaggctctccgaacaagtactggaactcctctacagccacttcactgtgcaacatttttaggggaagttacttggctggagcttctctaatctacacagtaacaagaaacgctggcttggtcaagagacgtgggggtggaacaggagagaccctgggagagaaatggaaggcccgcttgaaccagatgtcggccctggagttctactcctacaaaaagtcaggcatcaccgaggtgtgcagagaagaggcccgccgcgccctcaaggacggtgtggcaacgggaggccatgctgtgtcccgaggaagtgcaaagctgagatggttggtggagcggggatacctgcagccctatggaaaggtcattgatcttggatgtggcagagggggctggagttactacgccgccaccatccgcaaagttcaagaagtgaaaggatacacaaaaggaggccctggtcatgaagaacccatgttggtgcaaagctatgggtggaacatagtccgtcttaagagtggggtggacgtctttcatatggcggctgagccgtgtgacacgttgctgtgtgacataggtgagtcatcatctagtcctgaagtggaagaagcacggacgctcagagtcctctccatggtgggggattggcttgaaaaaagaccaggagccttttgtgtaaaagtgttgtgcccatacaccagcactatgatggaaaccctggagcgactgcagcgtaggtatgggggaggactggtcagagtgccactctcccgcaactctacacatgagatgtactgggtctctggagcgaaaagcaacaccataaaaagtgtgtccaccacgagccagctcctcttggggcgcatggacgggcccaggaggccagtgaaatatgaggaggatgtgaatctcggctctggcacgcgggctgtggtaagctgcgctgaagctcccaacatgaagatcattggtaaccgcattgaaaggatccgcagtgagcacgcggaaacgtggttctttgacgagaaccacccatataggacatgggcttaccatggaagctatgaggcccctacacaagggtcagcgtcctctctaataaacggggttgtcaggctcctgtcaaaaccctgggatgtggtgactggagtcacaggaatagccatgaccgacaccacaccgtatggtcagcaaagagttttcaaggaaaaagtggacaccagggtgccagacccccaagaaggcactcgtcaggttatgagcatggtctcttcctggttgtggaaagagctaggcaaacacaaacggccacgagtctgtaccaaagaagagttcatcaacaaggttcgtagcaatgcagcattaggggcaatatttgaagaggaaaaagagtggaagaccgcagtggaagctgtgaacgatccaaggttctgggctctagtggacaaggaaagagagcaccacctgagaggagagtgccagagctgtgtgtacaacatgatgggaaaaagagaaaagaaacaaggggaatttggaaaggccaagggcagccgcgccatctggtatatgtggctaggggctagatttctagagttcgaagcccttggattcttaaatgaggatcactggatggggagagagaactcaggaggtggtgttgaagggctgggattacaaagactcggatatgtcctagaagagatgagtcgcataccaggaggaaggatgtatgcagatgacactgctggctgggacacccgcatcagcaggtttgatctggagaatgaagctttaatcaccaaccaaatggagaaagggcacagggccttagcattggccataatcaagtacacataccaaaacaaagtggtaaaggtccttagaccagctgaaaaagggaagacagttatggacattatttcaagacaagaccaaagggggagcggacaagttgtcacttacgctcttaacacatttaccaacctagtggtgcaactcattcggaatatggaggctgaggaagttctagagatgcaagacttgtggctgctgcggaggtcagagaaagtgaccaactggttgcagagcaacggatgggataggctcaaacgaatggcagtcagtggagatgattgcgttgtgaagccaattgatgataggtttgcacatgccctcaggttcttgaatgatatgggaaaagttaggaaggacacacaagagtggaaaccctcaactggatgggacaactgggaagaagttccgttttgttcccaccacttcaacaagctccatctcaaggacgggaggtccattgtggttccctgccgccaccaagatgaactgattggccgggcccgtgtctctccaggggcgggatggagcatccgggagactgcttgcctagcaaagtcatatgcgcaaatgtggcagctcctttatttccacagaagggacctccgactgatggccaatgccatctgttcatctgtgccagttgactgggttccaactgggagaactacctggtcaatccatggaaagggagaatggatgaccactgaagacatgcttgtggtgtggaacagagtgtggattgaggagaacgaccacatggaagacaagaccccagttacgaaatggacagacattccctatctgggaaaaagggaagacttgtggtgtggatctctcatagggcacagaccgcgcaccacctgggctgagaacattaaaaacacagtcaacatggtgcgcaggatcataggtgatgaagaaaagtacatggactacctatccacccaagttcgctacttgggtgaagaagggtctacacctggagtgctataagcaccaatcttagtgttgtcaggcctgctagtcagccacagcttggggaaagctgtgcagcctgtgacccccccaggagaggctgggaaaccaagcccatagtcaggccgagaacgccatggcacggaagaagccatgctgcctgtgagcccctcagaggacactgagtcaaaaaaccccacgcgcttggaggcgcaggatgggaaaagaaggtggcgaccttccccacccttcaatctggggcctgaactggagatcagctgtggatctccagaagagggactagtggttagaggagaccccccggaaaacgcaaaacagcatattgacgctgggaaagaccagagactccatgagtttccaccacgctggccgccaggcacagatcgccgaatagcggcggccggtgtggggaaatccatgggtct

SEQ ID NO: 81 - DNA, 10755 bp, Zika virus
  Isolate ARB7701 polyprotein gene, complete cds
  misc_feature (3606)..(3607): n is a, c, g, or t
acctgttgatctgtgtgaatcagactgcgacagttcgagtttgaagcgagagctaacaacagtatcaacaggtttaatttggatttggaagcgagagtttctggtcatgaaaaacccaaagaagaaatccggaggattccggattgtcaatatgctaaaacgcggagtagcccgtgtaaaccccttgggaggtttgaagaggctgccagccggacttctgctgggtcatggacccatcagaatggttttggcaatactagcctttttgagatttacagcaatcaagccatcactgggcctcatcaacagatggggttctgtggggaaaaaagaggctatggaaataataaagaagtttaagaaagatcttgctgccatgttgagaataatcaatgctaggaaggagaggaagagacgtggtgcagacaccagcatcggaatcattggtctcctgctgactacagccatggcagcggagattaccagacgtggaagtgcatactacatgtacttggacaggagcgatgctgggaaggccatctcctttgctaccaacttgggagttaacaaatgccatgtacagatcatggatctcgggcacatgtgtgacgccaccatgagttatgagtgccctatgttggacgagggagtggaaccagatgatgtcgattgctggtgcaacacgacatcaacttgggttgtgtacggaacctgtcatcacaaaaaaggtgaagcacggcgatctagaagagctgtgacgctcccttctcactctacaaggaagttgcaaacgcggtcgcagacctggttagaatcaagagaatacacgaagcacctgatcaaggttgaaaactggatatttaggaaccccgggtttgcgctcgcagctgttgccattgcctggcttttgggaagctcgacgagccaaaaagtcatatacttggttatgatactgctgattgccccggcatacagcatcaggtgcattggagtcagcaatagagacttcgtggaaggcatgtcaggtgggacctgggttgatgtcgtcttggaacatggaggttgcgtcaccgttatggcacaggacaagccaacagttgacatagagttggtcacgacaacggttagtaacatggccgaggtaagatcctactgttatgaggcatcaatatcagacatggcttcggacagtcgctgcccaacacaaggtgaagcctaccttgataagcaatcagacacccaatatgtgtgcaaaagaacattggtggacagaggttggggaaatgggtgtggactttttggcaaagggagcctggtgacatgtgccaagttcacgtgttccaagaagatgactgggaagagcattcagccggagaatctggagtatcgaataatgctatcagtgcatggctcccagcacagcgggatgattgttaatgacataggacatgaaactgacgaaaacagagcgaaagtcgaggtcacgcccaattcaccaagagcagaagcaaccttgggaggctttggaagcttaggacttgattgtgaaccaaggacaggcctggacttttcagatttgtactacttgaccatgaacaacaagcactggttggtgcacaaagagtggtttcatgacatcccattgccttggcatgctggggcagataccggaactccacactggaacaacaaggaggcattggtagagttcaaagatgcccacgccaagaggcaaaccgtcgttgttctagggagccaggaaggagccgttcacacggctcttgctggagctctggaggctgagatggatggtgcaaaaggaaggctgttctccggccatttgaaatgccgcttaaaaatggacaagcttagattgaagggcgtgtcatattccttgtgcaccgcagcgttcacatttaccaaggtcccagctgaaacattgcatggaacagttacagtggaggtgcagtatgcagggacagatggaccctgcaaggtcccagcccagatggcggtggacatgcagaccctgaccccagtcgggaggctgataaccgccaaccctgtgattactgaaagcactgagaattcaaagatgatgttggagctcgacccaccatttggggattcttacattgtcataggagttggggacaagaaaatcacccatcactggcataggagtggtagcaccatcggaaaagcatttgaggccactgtgagaggtgccaagagaatggcagttctgggggatacagcctgggacttcggatcagtcgggggcgtgttcaactcattgggcaagggtgttcaccagatttttggagcagctttcaaatcactgtttggaggaatgtcctggttctcacagatcctcataggcacgctgctggtgtggttgggtttgaacacaaagaatggatccatctccctcacatgcttggccctggggggagtgatgatcttcctctccacggctgtctctgctgacgtggggtgctcggtggacttctcaaaaagagaaacgagatgtggcacgggggtgttcgtctacaatgatgttgaagcctggagggacaggtacaagtaccatcctgactccccccgcagattggcagcagcagtcaagcaggcttgggaagaggggatttgtgggatctcctccgtttcaagaatggaaaacatcatgtggaaatcagtggaaggggagctcaatgctatcttagaggagaatggagttcaactgacagttgttgtaggatctgtaaaaaaccccatgtggagaggcccacaaagattgccagtgcctgtgaatgagctgccccatggctggaaagcctgggggaaatcatattttgtcagagcggcaaagaccaacaacagttttgttgtcgatggtgacacactgaaggaatgtccgctcaaacacagagcatggaatagtttccttgtggaggatcatgggtttggggtcttccacaccagtgtttggctcaaggttagagaagactactcactagaatgtgacccagccgtcataggaacagctgttaagggaaaggaggccgcccacagtgacctgggctactggattgaaagtgaaaagaatgacacatggaggctgaagagggcccatctgattgagatgaaaacatgtgagtggccaaagtctcacactctgtggacagatggagtagaagaaagtgatctgatcatacctaaatctttagctggtccactcagccaccacaacactagagagggttacagaactcaagcaaaagggccatggcatagtgaagagcttgaaatccggtttgaggaatgtccaggcaccaaggttcacgtggaggagacatgcggaactagaggaccatctctgagatcaaccactgcaagtggaagggtcattgaggaatggtgctgtagagaatgcacaatgcccccactatcgtttcgagcaaaagacggctgctggtatggaatggagataaggcccaggaaagaaccagagagcaacttagtgaggtcaatggtgacagcgggatcaaccgatcacatggaccacttctctcttggagtgcttgtgattctactcatggtgcnngaagggctgaagaagagaatgaccacaaagatcattatgagcacatcaatggcagtgctggtggccatgatcctgggaggatttttaatgagtgacttggctaagcttgtgatcctgatgggtgccaccttcgcagaaatgaacactggaggagatgtggctcacttggcattggttgcggcatttaaagtcagaccagccttgctggtctcctttattttcagagctaattggacacctcgtgagagcatgctgctagccctggcttcgtgtcttttgcaaactgcaatctctgctctcgaaggtgacttgatggtcctcgtcaatggatttgctttggcctggttggcaatacgagcaatggccgtgccacgcactgacaacattgctctggcaatcctggctgctctgacaccactagcccgaggtacactgctcgtggcatggagagcgggcctcgctacttgtggagggtttatgctcctctccctgaaagggaaaggtagtgtgaagaagaacctgccatttgtcatggccttgggattgactgctgtgaggatagtagaccccattaatgtggtgggactactgttactcacaaggagtgggaagcggagctggccccctagtgaagtgcttacagctgttggcctgatatgtgcactggccggaggctttgccaaggcagacattgagatggctgggcccatggctgcagtaggcttgctgattgtcagttatgtggtctcaggaaagagtgtggatatgtacattgaaagagcaggtgacatcacatgggaaaaggacgcggaagttactggaaatagtcctcggcttgacgtggcactagatgagagtggtgatttctctctggtggaggaagatggtccacccatgagagagatcatactcaaggtggtcctgatggccatctgtggcatgaacccaatagccataccctttgctgcaggagcgtggtatgtgtatgtgaagactggaaaaaggagtggtgccctctgggatgtgcccgctcccaaagaagtgaaaaaaggagagaccacagatggggtatacagagtgatgacccgcagactgctgggttcaacacaggttggagtgggagtcatgcaagagggagtcttccacaccatgtggcacgtcacaaaaggagctgcactgaggagcggtgaagggagacttgatccatactggggggatgtcaagcaggacttagtgtcatactgtgggccttggaagttggatgcagcttgggatggacttagtgaggtgcagctcttggcagtaccccccggagagagggccagaaacattcagactctgcctggaatattcaagacaaaggatggggacatcggagcagtcgctctggactaccccgcaggaacttcaggatccccgatcctagacaaatgcggaagagtgataggactttatggcaatggggttgtgatcaagaatggaagctatgttagtgccataacccagggaaagagggaggaggagactccggttgaatgtttcgaaccctcgatgctgaagaagaagcagctaactgtcctggatctgcatccaggagccggaaagactaggagagttcttcctgaaatagtccgtgaagccataaaaaagagactccgcacagtgattttggctccaaccagggttgtcgctgctgagatggaggaagccttgagaggacttccggtgcgttacatgacaacagcagttaacgtcacccactctgggacagaaatcgttgatttgatgtgccatgccaccttcacctcacgcctattacaacccatcagagtccctaattacaatctctacatcatggatgaagcccatttcacagacccctcaagtatagctgcaagaggatacatatcaacaagggttgaaatgggcgaggcggctgccatcttcatgacagccacgccaccaggaacccgagatgcatttccagactccaactcaccaatcatggacacagaagtggaagtcccagagagagcctggagctcaggctttgattgggtgacagaccattctgggaaaacagtttggttcgttccaagtgtgagaaatggaaatgaaatcgcagcctgtctgacaaaggctggaaagcgggtcatacaactcagcaggaagacttttgagacagagtttcagaaaacaaaaaatcaagagtgggactttgtcataacaactgacatctcagagatgggcgcgaatttcaaagctgaccgggtcatagactctaggagatgcctaaagccagtcatacttgatggtgagagagtcatcttggctgggcccatgcctgtcacgcatgctagtgctgctcaaaggagagggcgtataggcaggaaccctaacaaacctggagatgagtacatgtatggaggtggatgtgcagagaccgatgaagaccatgcacactggcttgaagcaagaatgcttcttgacaacatctacctccaggatggcctcatagcctcgctctaccggcctgaggccgataaggtagctgccattgagggagagttcaagctgaggacagagcaaaggaaaacctttgtggaacttatgaagagaggagaccttcccgtttggctagcctatcaggttgcatctgccggaataacttacacagacagaagatggtgctttgatggcacaaccaacaacaccataatggaagatagtgtaccagcagaagtgtggacaaaatatggagagaagagagtgctcaaaccaagatggatggatgcgagggtctgttccgatcatgctgccctgaagtcgttcaaagaatttgctgccgggaaaagaggagtggctttaggagtaatggaggccctgggaacattgccaggacacatgacagagaggtttcaggaggccattgacaatctcgctgtgctcatgcgagcagagactggaagcaggccttacaaggcagcggcagcccaactgccggagaccctagagaccatcatgctcttaggcttgttgggaacagtttcgttggggatcttctttgtcttgatgcggaacaagggcatcgggaagatgggttttggaatggtaactcttggggccagtgcatggctcatgtggctttcggaaattgaaccagccagaattgcatgtgtcctcattgttgtgttcttgttactggtggtactcatacccgagccagagaagcaaagatctccccaggacaaccagatggcaatcatcatcatggtggcagtgggccttctgggtttgataactgcaaacgaacttggatggctggaaagaacaaaaaatgacatagctcatctaatgggaaggagagaagaaggagtaactatgggattctcaatggacatcgatttgcggccagcctccgcctgggctatctatgccgcactgacaactctcatcaccccagccgtccaacacgcggtaaccacttcatacaacaactactccctaatggcgatggccacacaagctggagtgctatttggcatgggcaaagggatgccattttatgcatgggactttggagtcccgctgctaatgatgggttgctactcacaattaacacccctaaccttgatagtggctatcattctgcttgtggcacactatatgtacttgatcccaggcctacaggcagcagcagcgcgtgctgcccagaagagaacagcagctggcatcatgaagaatcccgttgtggatggaatagtggtaactgacattgacacaatgacaattgacccccaagtggagaagaagatgggacaagtgttacttatagcagtagccatctccagtgctgtgctgctgcggactgcttggggatggggggaggctggagctctgattactgcagcaacctccaccttgtgggaaggttctccaaacaaatactggaactcctctacagccacctcactgtgcaacatcttcagaggaagttacctggcaggcgcttctcttatttatacagtgacaagaaatgctggcctagtcaagagacgtggaggtggaacgggagagactctaggagagaagtggaaagctcgcctgaatcagatgtcggccctggagttctactcttacaaaaagtcaggcatcactgaagtgtgtagagaggaggctcgccgcgccctcaaggatggagtggccacaggaggacatgctgtatcccggggaagcgcaaagctcagatggctggtggagagaggatacctgcaaccccatggaaaggttgttgacctcggatgtggcagagggggttggagctattatgccgccaccatccggaaagtgcaggaggtgaaaggatacacaaagggaggtcccggtcatgaagaacccatgctggtgcaaagctatgggtggaacatcgttcgtctcaagagtggagtggacgtcttccacatggcggccgagccgtgtgataccttgctgtgtgacataggtgagtcatcatctagtcctgaagtggaagagacgcgaacactccgagtgctctctatggtgggggactggcttgagaaaagaccgggggccttctgtataaaggtgctgtgtccatacaccagcactatgatggagaccatggagcgcctgcaacgtaggtatgggggaggattagtcagagtgccattgtctcgcaactccacacatgagatgtattgggtctctggagcaaaaagtaacgtcataaaaagtgtgtccaccacaagtcagctcctcctgggacgcatggatggtcccaggaggccagtgaaatatgaggaagatgtgaacctcggctcgggcacacgagctgtggcaagctgtgctgaagctcccaacatgaaggtcattggcaagcgcattgagagaatccgcagtgaacatgcagaaacatggttctttgatgaaaaccatccatacaggacatgggcctaccatgggagctacgaagcccccacacaagggtcagcatcttccctcgtgaatggggttgttagactcctgtcaaagccctgggatgtagtgactggagttacaggaatagctatgactgatacaacaccatacggccaacaaagagtcttcaaagaaaaagtggacaccagggtgccagatccccaagaaggcactcgccaggcaatgaacatggtctcttcctggctgtggaaggagttggggaaacgcaagcggccacgtgtctgcaccaaagaagagttcatcaacaaggtgcgcagcaatgcagcactgggagcaatatttgaagaggaaaaagaatggaagacggccgtggaggctgtgaatgatccaaggttttgggctctagtggacaaggaaagagaacatcacctgagaggagagtgccatagctgtgtgtacaatatgatgggaaaaagagagaagaagcaaggagaattcggaaaagcaaaaggcagccgcgccatctggtacatgtggttgggagccagattcttggagtttgaagcccttggattcttgaatgaggaccattggatgggaagagaaaactcaggaggtggtgtcgaagggctaggactgcaaagacttggatacattctagaagaaatgaatcgggcaccaggaggaaagatgtatgcagatgacaccgctggctgggacacccgcattagtaagtttgatctggagaatgaagccttaattaccaaccaaatggaggaagggcacagagctctggcgttggctgtgattaagtacacaaaaaacaaagtggtgaaggtcctcagaccagctgaaggagggaaaacagttatggacatcatttcaagacaggaccagagagggagtggacaagttgtcacctatgctctcaacacatttaccaacttagtggtgcagcttatccggaatatggaggctgaggaagtgttagagatgcaagacttatggctgttgaggaagccagagaaagtgaccagatggttgcagtgcaatggatgggacagactcaaacgaatggcagtcagtggagatgactgcgttgtgaagccaattgatgataggtttgcgcatgccctcaggttcttaaatgacatgggaaaagttaggaaagacacacaggaatggaaaccctcgactggatggagcaattgggaagaagtcccgttctgctcccaccatttcaacaagctgcacctcaaggatggtagatccattgtggtcccttgccgccaccaagatgaattgattggccgagcccgtgtatcaccaggggcaggatggagcattcgggagactgcctgtctagcaaaatcatatgcacagatgtggcagcttctttacttccacagaagagaccttcgactgatggccaatgctatttgttcggctgtgccagttgactgggtaccaaccgggagaaccacctggtcaatccacggaaagggagaatggatgactactgaggacatgctcatggtgtggaatagagtgtggattgaggagaacgaccatatggaggacaagactcctgtgacaaagtggacagacatcccctatctgggaaaaagggaggacttatggtgtggatcccttatagggcacaggccccgcaccacttgggctgagaacatcaaagacacagtcaacatggtgcgcaggatcataggtgatgaagaaaaatacatggactacttatccacccaggtccgctacttgggtgaggaagggtccacacctggagtgttgtaagcaccaatttcagtgttgtcaggcctgctagccagccacagtttggggaaagctgtgcagcctgtagcccccccaggagaagctgggaaaccaagctcatagtcaggccgagaacgccatggcacggaagaagccatgctgcctgtgagcccctcagaggacactgagttaaaaaaccccacgcgcttggaagcgcaggatgggaaaagaaggtggcgaccttccccaccctttaatctggggcctgaactggagactagctgtgaatctccagcagagggactagtggttagaggagaccccccggaaaacgcaaaacagcatattgacgctgggaaagaccagagactccatgagtttccaccacgctggccgccagg

SEQ ID NO: 82 - DNA, 10776 bp, Zika virus
  Isolate ARB15076 polyprotein gene, complete cds
gttgttgatctgtgtgaatcagactgcgacagttcgagtttgaagcgagagctaacaacagtatcaacaggtttaatttggatttggaaacgagagtttctggtcatgaaaaacccaaagaagaaatccggaggattccggattgtcaatatgctaaaacgcggagtagcccgtgtaaaccccttgggaggtttgaagaggctgccagccggactcctgctgggtcatggacccatcagaatggttttggcaatactagcctttttgagatttacagcaatcaagccatcactgggcctcatcaacagatggggttcagtggggaaaaaagaggctatggaaataataaagaagtttaagaaagatcttgctgccatgttgagaataatcaatgctaggaaggagaggaagagacgtggtgcagacaccagcatcggaatcattggtctcctgctgactacagccatggcagcagagattaccagacgtggaagtgcatactacatgtacttggacaggagcgatgctgggaaggccatctcctttgctaccaatttgggagttaacaaatgccatgtacagatcatggatctcgggcacatgtgtgacgccaccatgagttatgagtgtcctatgttggacgagggagtggaaccagatgatgtcgattgctggtgcaacacgacatcaacttgggttgtgtacggaacctgtcatcacaaaaaaggtgaagcacggcgatctagaagagctgtgacgctcccttctcactctacaaggaagctgcaaacgcggtcgcagacttggttagaatcaagagaatacacgaagcacttgatcaaggttgaaaactggatattcaggaaccccgggtttgcgctcgcagctgttgccattgcctggcttttgggaagctcgacgagccaaaaagtcatatacttggtcatgatactgctgattgccccggcatacagcatcaggtgcattggagtcagcaatagagacttcgtggaaggcatgtcaggtgggacctgggttgatgtcgtcttggaacatggaggttgcgtcaccgtaatggcacaggacaagccaacagttgacatagagttggtcacgacaacggtcagtaacatggccgaggtaagatcctactgttatgaggcatcaatatcggacatggcttcggacagtcgctgcccaacacaaggtgaagcctaccttgacaagcaatcagacactcaatatgtatgcaaaagaacattggtggacagaggttggggaaatgggtgtggactttttggcaaagggagcctggtgacatgtgccaagttcacgtgttccaagaagatgaccgggaagagcattcagccggagaatctggagtatcgaataatgctatcagtgcatggctcccagcacagcgggatgattgttaatgacgaaaatagggcgaaagtcgaggtcacgcccaattcaccaagagcagaagcaaccttgggaggctttggaagcttaggacttgattgtgaaccaaggacaggcctggacttttcagatttgtactacttgaccatgaacaataagcactggttagtgcacaaagagtggtttcatgacatcccattgccctggcatgctggggcagacaccggaactccacattggaacaacaaggaggcattggtagagttcaaagatgcccacgctaagaggcaaaccgtcgttgttctagggagccaggaaggagccgttcacacggctcttgctggagctctggaggctgagatggatggtgcaaaaggaaggttgttctccggccatttgaaatgccgcttaaaaatggacaagcttagattgaagggcgtgtcatattccttgtgcaccgcagcgttcacattcaccaaggtcccagctgaaacattgcatggaacagttacagtggaggtgcagtatgcagggacagatggaccctgcaaggtcccagctcagatggcggtggacatgcagaccctgaccccagtcggaaggctgataaccgccaaccccgtgattactgaaagcactgagaattcaaagatgatgttggagctcgacccaccatttggggattcttacattgtcataggagttggggacaagaaaattacccaccactggcataggagtggtagcaccatcggaaaagcatttgaggccactgtgagaggtgccaagagaatggcagttctgggggacacagcctgggactttggatcagtcgggggcgtgtttaactcattgggcaagggcatccaccagatttttggagcagccttcaaatcactgtttggaggaatgtcctggttctcacagatcctcataggcacgctgctggtgtggttgggtttgaacacaaagaatggatccatctccctcacatgcttggccctggggggagtgatgatcttcctctccacggctgtctctgctgacgtggggtgctcggtggacttctcaaaaagagaaacgagatgtggcacgggggtgttcgtctacaatgatgttgaagcctggagggacaggtacaagtaccatcctgactccccccgcagattggcagcagcagtcaagcaggcttgggaagagggaatttgtgggatctcctccgtttcaagaatggaaaacatcatgtggaaatcagtggaaggggagctcaatgctatcttagaggagaatggagttcaactgacagttgttgtaggatctgtaaaaaaccccatgtggagaggtccacaaagattgccagtgcctgtgaatgagctgccccatggctggaaagcctgggggaaatcatattttgtcagagcggcaaagaccaacaacaggtttgttgtcgatggtgacacactgaaggaatgtccgctcaaacacagagcatggaatagtttccttgtggaggatcatgggtttggggtcttccacaccagtgtttggcttaaggttagagaagattactcactagaatgtgacccagccgtcataggaacagctgttaagggaaaggaggccgcgcacagtgacctaggctactggattgaaagtgaaaagaatgacacatggaggctgaagagggcccacctgattgagatgaaaacatgtgagtggccaaagtctcacactctgtggacagatggagtagaagaaagtgatctgatcatacctaaatctttagctggtccactcagccaccacaacactagagagggttacagaactcaagcaaaagggccatggcatagtgaagagcttgaaatccggtttgaggaatgtccaggcaccaaggttcatgtggaggagacatgcggaactagaggaccatctctgagatcaaccactgcaagtggaagggtcattgaggaatggtgctgtagagaatgcacaatgcccccactatcgtttcgagcaaaagatggctgctggtatggaatggagataaggcccaggaaagaaccagagagcaacttagtgaggtcaatggtgacagcgggatcaaccgatcacatggaccacttctctcttggagtgcttgtgattctactcatggtgcaggaagggttgaagaagagaatgaccacgaagatcattatgagcacatcaatggcagtgctggtagccatgatcctgggaggattttcaatgagtgacctggctaagcttgtgatcctgatgggtgccaccttcgcagaaatgaacactggaggagatgtggctcacttggcattggttgcggcatttaaagtcagaccagccttgctggtctcctttattttcagagctaattggacacctcgtgagagcatgctgctagccctggcttcgtgtcttttacaaactgcaatctctgctcttgaaggtgacttgatggtcctcgtcaatggatttgctttggcctggttggcaatacgagcaatggccgtgccacgcactgacaacattgctctagcagtcctggctgctctgacaccactagcccgaggcacactgctcgtggcatggagagcgggcctcgctacttgtggagggttcatgctcctttccctgaaggggaaaggtagtgtgaagaagaacctgccatttgtcatggccttgggattgaccgctgtgaggatagtagaccccattaatgtggtaggactactgttactcacaaggagcgggaagcggagctggccccctagtgaagtgcttacagctgttggcctgatatgtgcactggccggagggtttgccaaggcagacattgagatggctgggcccatggctgcagtaggcttgctaattgtcagttatgtggtctcaggaaagagtgtggatatgtacattgaaagagcaggtgacatcacatgggaaaaggacgcggaagttactggaaatagtcctcggcttgacgtggcactagatgagagtggtgatttctctctggtggaggaagatggtccacccatgagagagatcatactcaaggtggtcctgatggccatctgtggcatgaacccaatagccataccctttgctgcaggagcgtggtatgtgtatgtgaagactgggaaaaggagtggtgccctctgggatgtgcccgctcccaaagaagtgaaaaaaggagagaccacagatggagtatacagagtgatgacccgcagactgctgggttcaacacaggttggagttggagtcatgcaagagggagtcttccacaccatgtggcacgtcacaaaaggagctgcactgaggagcggcgaagggagacttgatccatactggggggatgtcaagcaggacttagtgtcatactgtgggccttggaagttggatgcagcttgggatggacttagtgaggtgcagctcttggcagtaccccccggagagagggccagaaacattcagactctgcctggaatattcaagacaaaggatggggacatcggagcagttgctctggactaccccgcaggaacttcaggatccccgatcctagacaaatgcggaagagtgataggactttatggcaatggggttgtgatcaagaatggaagctatgttagtgccataacccagggaaagagggaggaggagactccggttgaatgtttcgaaccctcgatgctgaagaagaagcagctaactgtcctggatctgcatccaggagccggaaagactaggagagttcttcctgaaatagtccgtgaagccataaaaaagagactccgcacagtgattttggctccaaccagggttgtcgctgctgagatggaggaagccttgagaggacttccggtgcgttacatgacaacagcagttaacgtcacccactctgggacagaaatcgttgatttgatgtgccatgccaccttcacttcacgcttattacaacccatcagagtccctaattacaatctctacatcatggatgaagcccatttcacagacccctcaagtatagctgcaagaggatacatatcaacaagggttgaaatgggcgaggcggctgccatctttatgacagccacgccaccaggaacccgagatgcatttccagactccaactcaccaatcatggacacagaagtggaagtcccagagagagcctggagctcaggctttgattgggtgacagaccattctggaaaaacagtttggtttgttccaagtgtgagaaatggaaatgaaatcgcagcctgtctgacaaaggctggaaagcgggtcatacaactcagcaggaagacttttgagacagagtttcagaaaacaaaaaatcaagagtgggactttgtcataacaactgacatctcagagatgggtgccaatttcaaggctgaccgggtcatagactctaggagatgcctaaagccagttatacttgatggtgagagagtcatcttggctgggcccatgcctgtcacgcatgctagtgctgctcaaaggagagggcgtataggcaggaaccctaacaaacctggagatgagtacatgtatggaggtggatgtgcagagaccgatgaagaccatgcacactggcttgaagcaagaatgcttcttgacaacatctacctccaggatggcctcatagcttcgctctaccggcctgaggccgacaaggtagccgccattgagggagagttcaagctgaggacggagcaaaggaaaacctttgtggaacttatgaagagaggagaccttcccgtttggctggcctatcaggttgcatctgccggaataacttacacagacagaagatggtgctttgatggcacaaccaacaacaccataatggaagatagtgtaccagcagaggtgtggacaaaatatggagagaagagagtgcttaaaccaagatggatggatgcgagggtctgttctgatcatgctgccctgaagtcgttcaaagaatttgctgccgggaaaagaggagcggctttaggagtaatggaggccctgggaacattaccaggacacatgacagagaggtttcaggaggccattgacaatctcgctgtgcttatgcgagcagagactggaagtaggccttacaaggcagcggcagcccaactgccggagaccctagagaccatcatgctcctaggtttgctgggaacagtttcgttggggatcttctttgtcttgatgcggaacaagggcatcgggaagatgggttttggaatggtaactcttggggccagtgcatggctcatgtggctttcggaaattgagccagccagaattgcatgtgtcctcattgttgtgttcttgttactggtggtactcatacccgagccagagaagcaaagatctccccaggacaaccagatggcaatcatcatcatggtggcagtgggccttctgggtttgataactgcaaacgaacttggatggctggaaagaacaaaaaatgacatagctcatctaatgggaaggagagaagaaggagtaactatgggattctcaatggacatcgatttgcggccagcctccgcctgggctatttatgccgcactgacaactctcatcaccccagctgtccaacacgcggtaaccacttcatacaacaactactccctaatggcgatggccacacaagctggagtgctatttggcatgggcaaagggatgccattttatgcatgggactttggagtcccgctgctaatggtgggttgctactcacaattaacacccctaaccttgatagtggctatcattctgcttgtggcacactacatgtacttgatcccaggcctacaggcagcagcagcgcgtgctgcccagaagagaacagcagctggcatcatgaagaatcccgttgtggatggaatagtggtaactgacattgacacaatgacaattgacccccaagtggagaagaagatgggacaagtgttactcatagcagtagccatctccagtgctgtgctgctgcgaactgcttggggatggggggaggctggagctctgatcacagcagcaacctccaccttgtgggaaggttctccaaacaaatactggaactcctctacagccacctcactgtgcaacatctttagaggaagttacctggcaggcgcttctctcatttatacagtgacaagaaatgctggcctagtcaagagacgtggaggtggaacgggagagactctaggagagaagtggaaagctcgcctgaatcagatgtcggccctggagttctactcttacaaaaagtcaggcatcactgaagtgtgtagagaggaggctcgccgcgccctcaagaatggagtggccacaggaggacatgctgtatcccggggaagcgcaaagctcagatggctggtggagagaggatacctgcaaccccatggaaaggttgttgacctcggatgtggcagagggggttggagctattatgccgccaccatccggaaagtgcaggaggtgaaaggatacacaaagggaggtcctggtcatgaagaacccatgctggtgcaaagctatgggtggaacatagttcgtctcaagagtggagtggatgtcttccacatggcggccgagccgtgtgacaccttgctgtgcgacataggtgagtcatcatctagtcctgaagtggaagagacgcgaacactcagagtgctctctatggtgggggactggcttgagaaaagaccgggagccttctgcataaaggtgctgtgcccatacaccagcactatgatggagaccatggagcgcctgcaacgtaggtatgggggaggattagtcagagtgccattgtctcgcaactccacacatgaaatgtattgggtctctggagcaaaaagtaacatcataaaaagtgtgtccaccacaagtcagctcctcctgggacgcatggatggccccaggaggccagtgaaatatgaggaagatgtgaacctcggctcgggcacacgagctgtggcaagctgtgctgaagctcccaacatgaagatcattggcaagcgcattgagagaatccgcagtgaacatgcagaaacatggttctttgatgaaaaccacccatacaggacatgggcctaccatgggagctacgaagcccccacccaaggatcagcgtcttccctcgtgaatggggttgttagactcctgtcaaagccctgggatgttgtgactggagttacaggaatagctatgactgacactacaccatacggccaacaaagagtcttcaaagaaaaagtggacaccagggtgccagatcctcaagaaggcactcgccagacaatgaacatggtttcttcctggctgtggaaggagctggggaaacgcaagcggccacgtgtctgcaccaaagaagagttcatcaacaaggtgcgcagcaatgcagcactgggagcaatatttgaagaggaaaaagaatggaagacggccgtggaagctgtgaatgatccaaggttttgggccctagtggacaaggagagagaacatcacctgagaggagagtgccatagctgtgtgtacaatatgatgggaaaaagagagaagaagcaaggagaattcggaaaagcaaaaggcagccgcgccatctggtacatgtggttgggagccagattcttggagtttgaagcccttggattcttgaatgaggaccattggatgggaagagaaaactcaggaggtggtgtcgaagggctaggactgcaaagacttggatacattctagaagaaatgaatcgagcaccaggaggaaagatgtatgcagatgacaccgctggctgggatacccgtattagtaagtttgatctggagaatgaagccttaattaccaaccaaatggaggaagggcatagagctctagcattggctgtgattaagtacacataccaaaacaaagtggtgaaggtcctcagaccagctgaaggagggaaaacagttatggacatcatttcaagacaagaccagagagggagtggacaagttgtcacttatgctctcaacacatttaccaacttggtggtgcagcttatccggaacatggaggctgaggaagtgctagagatgcaagacttatggctgctgaggaagccagagaaagtgaccagatggttgcagtgcaatggatgggacagactcaaacgaatggcagtcagtggagatgactgcgttgtgaagccaattgatgataggtttgcacatgccctcaggttcttgaatgacatgggaaaagttaggaaagacacacaggaatggaaaccctcgactggatggagcaattgggaagaagtcccgttctgctcccaccatttcaacaagctgcacctcaaggatggtagatccattgtggtcccttgccgccaccaagatgaattgattggccgagcccgtgtatcaccaggggcaggatggagcatccgggagactgcctgtctagcaaaatcatatgcacagatgtggcagcttctttacttccacagaagagaccttcgactgatggccaatgctatttgttcggctgtgccagttgactgggtgccaaccgggagaaccacctggtcaatccacggaaagggagaatggatgactactgaggacatgctcatggtgtggaatagagtgtggattgaggagaacgaccacatggaggacaagactcctgtgacaaagtggacagacatcccctatctgggaaaaagggaggacttatggtgtggatcccttatagggcacaggccccgcaccacttgggctgagaacatcaaagacacagtcaacatggtgcgcaggatcataggtgatgaagaaaaatacatggactacttatccacccaggtccgctacttgggtgaggaagggtccacacctggagtgttgtaagcaccaatttcagtgttgtcaggcctgctagtcagccacagtttggggaaagctgtgcagcctgtagcccccccaggagacgctgggaaaccaagctcatagtcaggccgagaacgccatggcacggaagaagccatgctgcctgtgagcccctcagaggacactgagtcaaaaaaccccacgcgcttggaagcgcaggatgggaaaagaaggtggcgaccttccccaccctttaatctggggcctgaactggagactagctgtgaatctccagcagagggactagtggttagaggagaccccccggaaaacgcaaaacagcatattgacgctgggaaagaccagagactccatgagtttccaccacgctggccgccaggcacagatcgccgaacagcggcggccagtgtggtggaa

SEQ ID NO: 83 - DNA, 10788 bp, Zika virus
  Isolate ARB13565 polyprotein gene, complete cds
agttgttgatctgtgtgaatcagactgcgacagttcgagtttgaagcgagagctaacaacagtatcaacaggtttaatttggatttggaagcgagagtttctggtcatgaaaaacccaaagaagaaatccggaggattccggattgtcaatatgctaaaacgcggagtagcccgtgtaaaccccttgggaggtttgaagaggctgccagccggacttctgctgggtcatggacccatcagaatggttttggcaatactagcctttttgagatttacagcaatcaagccatcactgggcctcatcaacagatggggttctgtggggaaaaaagaggctatggaaataataaagaagtttaagaaagatcttgctgccatgttgagaataatcaatgctaggaaggagaggaagagacgtggtgcagacaccagcatcggaatcattggtctcctgctgactacagccatggcagcggagattaccagacgtggaagtgcatactacatgtacttggacaggagcgatgctgggaaggccatctcctttgctaccaacttgggagttaacaaatgccatgtacagatcatggatctcgggcacatgtgtgacgccaccatgagttatgagtgccctatgttggacgagggagtggaaccagatgatgtcgattgctggtgcaacacgacatcaacttgggttgtgtacggaacctgtcatcacaaaaaaggtgaagcacggcgatctagaagagctgtgacgctcccttctcactctacaaggaagttgcaaacgcggtcgcagacctggttagaatcaagagaatacacgaagcacctgatcaaggttgaaaactggatatttaggaaccccgggtttgcgctcgcagctgttgccattgcctggcttttgggaagctcgacgagccaaaaagtcatatacttggttatgatactgctgattgccccggcatacagcatcaggtgcattggagtcagcaatagagacttcgtggaaggcatgtcaggtgggacctgggttgatgtcgtcttggaacatggaggttgcgtcaccgttatggcacaggacaagccaacagttgacatagagttggtcacgacaacggttagtaacatggccgaggtaagatcctactgttatgaggcatcaatatcagacatggcttcggacagtcgctgcccaacacaaggtgaagcctaccttgataagcaatcagacacccaatatgtgtgcaaaagaacattggtggacagaggttggggaaatgggtgtggactttttggcaaagggagcctggtgacatgtgccaagttcacgtgttccaagaagatgactgggaagagcattcagccggagaatctggagtatcgaataatgctatcagtgcatggctcccagcacagcgggatgattgttaatgacataggacatgaaactgacgaaaacagagcgaaagtcgaggtcacgcccaattcaccaagagcagaagcaaccttgggaggctttggaagcttaggacttgattgtgaaccaaggacaggcctggacttttcagatttgtactacttgaccatgaacaacaagcactggttggtgcacaaagagtggtttcatgacatcccattgccttggcatgctggggcagataccggaactccacactggaacaacaaggaggcattggtagagttcaaagatgcccacgccaagaggcaaaccgtcgttgttctagggagccaggaaggagccgttcacacggctcttgctggagctctggaggctgagatggatggtgcaaaaggaaggctgttctccggccatttgaaatgccgcttaaaaatggacaagcttagattgaagggcgtgtcatattccttgtgcaccgcagcgttcacatttaccaaggtcccagctgaaacattgcatggaacagttacagtggaggtgcagtatgcagggacagatggaccctgcaaggtcccagcccagatggcggtggacatgcagaccctgaccccagtcgggaggctgataaccgccaaccctgtgattactgaaagcactgagaattcaaagatgatgttggagctcgacccaccatttggggattcttacattgtcataggagttggggacaagaaaatcacccatcactggcataggagtggtagcaccatcggaaaagcatttgaggccactgtgagaggtgccaagagaatggcagttctgggggatacagcctgggacttcggatcagtcgggggcgtgttcaactcattgggcaagggtgttcaccagatttttggagcagctttcaaatcactgtttggaggaatgtcctggttctcacagatcctcataggcacgctgctggtgtggttgggtttgaacacaaagaatggatccatctccctcacatgcttggccctggggggagtgatgatcttcctctccacggctgtctctgctgacgtggggtgctcggtggacttctcaaaaagagaaacgagatgtggcacgggggtgttcgtctacaatgatgttgaagcctggagggacaggtacaagtaccatcctgactccccccgcagattggcagcagcagtcaagcaggcttgggaagaggggatttgtgggatctcctccgtttcaagaatggaaaacatcatgtggaaatcagtggaaggggagctcaatgctatcttagaggagaatggagttcaactgacagttgttgtaggatctgtaaaaaaccccatgtggagaggcccacaaagattgccagtgcctgtgaatgagctgccccatggctggaaagcctgggggaaatcatattttgtcagagcggcaaagaccaacaacagttttgttgtcgatggtgacacactgaaggaatgtccgctcaaacacagagcatggaatagtttccttgtggaggatcatgggtttggggtcttccacaccagtgtttggctcaaggttagagaagactactcactagaatgtgacccagccgtcataggaacagctgttaagggaaaggaggccgcccacagtgacctgggctactggattgaaagtgaaaagaatgacacatggaggctgaagagggcccatctgattgagatgaaaacatgtgagtggccaaagtctcacactctgtggacagatggagtagaagaaagtgatctgatcatacctaaatctttagctggtccactcagccaccacaacactagagagggttacagaactcaagcaaaagggccatggcatagtgaagagcttgaaatccggtttgaggaatgtccaggcaccaaggttcacgtggaggagacatgcggaactagaggaccatctctgagatcaaccactgcaagtggaagggtcattgaggaatggtgctgtagagaatgcacaatgcccccactatcgtttcgagcaaaagacggctgctggtatggaatggagataaggcccaggaaagaaccagagagcaacttagtgaggtcaatggtgacagcgggatcaaccgatcacatggaccacttctctcttggagtgcttgtgattctactcatggtgcaggaagggctgaagaagagaatgaccacaaagatcattatgagcacatcaatggcagtgctggtggccatgatcctgggaggatttttaatgagtgacttggctaagcttgtgatcctgatgggtgccaccttcgcagaaatgaacactggaggagatgtggctcacttggcattggttgcggcatttaaagtcagaccagccttgctggtctcctttattttcagagctaattggacacctcgtgagagcatgctgctagccctggcttcgtgtcttttgcaaactgcaatctctgctctcgaaggtgacttgatggtcctcgtcaatggatttgctttggcctggttggcaatacgagcaatggccgtgccacgcactgacaacattgctctggcaatcctggctgctctgacaccactagcccgaggtacactgctcgtggcatggagagcgggcctcgctacttgtggagggtttatgctcctctccctgaaagggaaaggtagtgtgaagaagaacctgccatttgtcatggccttgggattgactgctgtgaggatagtagaccccattaatgtggtgggactactgttactcacaaggagtgggaagcggagctggccccctagtgaagtgcttacagctgttggcctgatatgtgcactggccggaggctttgccaaggcagacattgagatggctgggcccatggctgcagtaggcttgctgattgtcagttatgtggtctcaggaaagagtgtggatatgtacattgaaagagcaggtgacatcacatgggaaaaggacgcggaagttactggaaatagtcctcggcttgacgtggcactagatgagagtggtgatttctctctggtggaggaagatggtccacccatgagagagatcatactcaaggtggtcctgatggccatctgtggcatgaacccaatagccataccctttgctgcaggagcgtggtatgtgtatgtgaagactggaaaaaggagtggtgccctctgggatgtgcccgctcccaaagaagtgaaaaaaggagagaccacagatggggtatacagagtgatgacccgcagactgctgggttcaacacaggttggagtgggagtcatgcaagagggagtcttccacaccatgtggcacgtcacaaaaggagctgcactgaggagcggtgaagggagacttgatccatactggggggatgtcaagcaggacttagtgtcatactgtgggccttggaagttggatgcagcttgggatggacttagtgaggtgcagctcttggcagtaccccccggagagagggccagaaacattcagactctgcctggaatattcaagacaaaggatggggacatcggagcagtcgctctggactaccccgcaggaacttcaggatccccgatcctagacaaatgcggaagagtgataggactttatggcaatggggttgtgatcaagaatggaagctatgttagtgccataacccagggaaagagggaggaggagactccggttgaatgtttcgaaccctcgatgctgaagaagaagcagctaactgtcctggatctgcatccaggagccggaaagactaggagagttcttcctgaaatagtccgtgaagccataaaaaagagactccgcacagtgattttggctccaaccagggttgtcgctgctgagatggaggaagccttgagaggacttccggtgcgttacatgacaacagcagttaacgtcacccactctgggacagaaatcgttgatttgatgtgccatgccaccttcacctcacgcctattacaacccatcagagtccctaattacaatctctacatcatggatgaagcccatttcacagacccctcaagtatagctgcaagaggatacatatcaacaagggttgaaatgggcgaggcggctgccatcttcatgacagccacgccaccaggaacccgagatgcatttccagactccaactcaccaatcatggacacagaagtggaagtcccagagagagcctggagctcaggctttgattgggtgacagaccattctgggaaaacagtttggttcgttccaagtgtgagaaatggaaatgaaatcgcagcctgtctgacaaaggctggaaagcgggtcatacaactcagcaggaagacttttgagacagagtttcagaaaacaaaaaatcaagagtgggactttgtcataacaactgacatctcagagatgggcgcgaatttcaaagctgaccgggtcatagactctaggagatgcctaaagccagtcatacttgatggtgagagagtcatcttggctgggcccatgcctgtcacgcatgctagtgctgctcaaaggagagggcgtataggcaggaaccctaacaaacctggagatgagtacatgtatggaggtggatgtgcagagaccgatgaagaccatgcacactggcttgaagcaagaatgcttcttgacaacatctacctccaggatggcctcatagcctcgctctaccggcctgaggccgataaggtagctgccattgagggagagttcaagctgaggacagagcaaaggaaaacctttgtggaacttatgaagagaggagaccttcccgtttggctagcctatcaggttgcatctgccggaataacttacacagacagaagatggtgctttgatggcacaaccaacaacaccataatggaagatagtgtaccagcagaagtgtggacaaaatatggagagaagagagtgctcaaaccaagatggatggatgcgagggtctgttccgatcatgctgccctgaagtcgttcaaagaatttgctgccgggaaaagaggagtggctttaggagtaatggaggccctgggaacattgccaggacacatgacagagaggtttcaggaggccattgacaatctcgctgtgctcatgcgagcagagactggaagcaggccttacaaggcagcggcagcccaactgccggagaccctagagaccatcatgctcttaggcttgttgggaacagtttcgttggggatcttctttgtcttgatgcggaacaagggcatcgggaagatgggttttggaatggtaactcttggggccagtgcatggctcatgtggctttcggaaattgaaccagccagaattgcatgtgtcctcattgttgtgttcttgttactggtggtactcatacccgagccagagaagcaaagatctccccaggacaaccagatggcaatcatcatcatggtggcagtgggccttctgggtttgataactgcaaacgaacttggatggctggaaagaacaaaaaatgacatagctcatctaatgggaaggagagaagaaggagtaactatgggattctcaatggacatcgatttgcggccagcctccgcctgggctatctatgccgcactgacaactctcatcaccccagccgtccaacacgcggtaaccacttcatacaacaactactccctaatggcgatggccacacaagctggagtgctatttggcatgggcaaagggatgccattttatgcatgggactttggagtcccgctgctaatgatgggttgctactcacaattaacacccctaaccttgatagtggctatcattctgcttgtggcacactatatgtacttgatcccaggcctacaggcagcagcagcgcgtgctgcccagaagagaacagcagctggcatcatgaagaatcccgttgtggatggaatagtggtaactgacattgacacaatgacaattgacccccaagtggagaagaagatgggacaagtgttacttatagcagtagccatctccagtgctgtgctgctgcggactgcttggggatggggggaggctggagctctgattactgcagcaacctccaccttgtgggaaggttctccaaacaaatactggaactcctctacagccacctcactgtgcaacatcttcagaggaagttacctggcaggcgcttctcttatttatacagtgacaagaaatgctggcctagtcaagagacgtggaggtggaacgggagagactctaggagagaagtggaaagctcgcctgaatcagatgtcggccctggagttctactcttacaaaaagtcaggcatcactgaagtgtgtagagaggaggctcgccgcgccctcaaggatggagtggccacaggaggacatgctgtatcccggggaagcgcaaagctcagatggctggtggagagaggatacctgcaaccccatggaaaggttgttgacctcggatgtggcagagggggttggagctattatgccgccaccatccggaaagtgcaggaggtgaaaggatacacaaagggaggtcccggtcatgaagaacccatgctggtgcaaagctatgggtggaacatcgttcgtctcaagagtggagtggacgtcttccacatggcggccgagccgtgtgataccttgctgtgtgacataggtgagtcatcatctagtcctgaagtggaagagacgcgaacactccgagtgctctctatggtgggggactggcttgagaaaagaccgggggccttctgtataaaggtgctgtgtccatacaccagcactatgatggagaccatggagcgcctgcaacgtaggtatgggggaggattagtcagagtgccattgtctcgcaactccacacatgagatgtattgggtctctggagcaaaaagtaacgtcataaaaagtgtgtccaccacaagtcagctcctcctgggacgcatggatggtcccaggaggccagtgaaatatgaggaagatgtgaacctcggctcgggcacacgagctgtggcaagctgtgctgaagctcccaacatgaaggtcattggcaagcgcattgagagaatccgcagtgaacatgcagaaacatggttctttgatgaaaaccatccatacaggacatgggcctaccatgggagctacgaagcccccacacaagggtcagcatcttccctcgtgaatggggttgttagactcctgtcaaagccctgggatgtagtgactggagttacaggaatagctatgactgatacaacaccatacggccaacaaagagtcttcaaagaaaaagtggacaccagggtgccagatccccaagaaggcactcgccaggcaatgaacatggtctcttcctggctgtggaaggagttggggaaacgcaagcggccacgtgtctgcaccaaagaagagttcatcaacaaggtgcgcagcaatgcagcactgggagcaatatttgaagaggaaaaagaatggaagacggccgtggaggctgtgaatgatccaaggttttgggctctagtggacaaggaaagagaacatcacctgagaggagagtgtcatagctgtgtgtacaacatgatgggaaaaagagagaagaagcaaggagaattcggaaaagcaaaaggcagccgcgccatctggtacatgtggttgggagccagattcttggagtttgaagcccttggattcttgaatgaggaccattggatgggaagagaaaactcaggaggtggtgtcgaagggctaggactgcaaagacttggatacattctagaagaaatgaatcgggcaccaggaggaaagatgtatgcagatgacaccgctggctgggacacccgcattagtaagtttgatctggagaatgaagccttaattaccaaccaaatggaggaagggcacagagctctggcgttggctgtgattaagtacacaaaaaacaaagtggtgaaggtcctcagaccagctgaaggagggaaaacagttatggacatcatttcaagacaggaccagagagggagtggacaagttgtcacctatgctctcaacacatttaccaacttagtggtgcagcttatccggaatatggaggctgaggaagtgttagagatgcaagacttatggctgttgaggaagccagagaaagtgaccagatggttgcagtgcaatggatgggacagactcaaacgaatggcagtcagtggagatgactgcgttgtgaagccaattgatgataggtttgcgcatgccctcaggttcttaaatgacatgggaaaagttaggaaagacacacaggaatggaaaccctcgactggatggagcaattgggaagaagtcccgttctgctcccaccatttcaacaagctgcacctcaaggatggtagatccattgtggtcccttgccgccaccaagatgaattgattggccgagcccgtgtatcaccaggggcaggatggagcattcgggagactgcctgtctagcaaaatcatatgcacagatgtggcagcttctttacttccacagaagagaccttcgactgatggccaatgctatttgttcggctgtgccagttgactgggtaccaaccgggagaaccacctggtcaatccacggaaagggagaatggatgactactgaggacatgctcatggtgtggaatagagtgtggattgaggagaacgaccatatggaggacaagactcctgtgacaaagtggacagacatcccctatctgggaaaaagggaggacttatggtgtggatcccttatagggcacaggccccgcaccacttgggctgagaacatcaaagacacagtcaacatggtgcgcaggatcataggtgatgaagaaaaatacatggactacttatccacccaggtccgctacttgggtgaggaagggtccacacctggagtgttgtaagcaccaatttcagtgttgtcaggcctgctagccagccacagtttggggaaagctgtgcagcctgtagcccccccaggagaagctgggaaaccaagctcatagtcaggccgagaacgccatggcacggaagaagccatgctgcctgtgagcccctcagaggacactgagttaaaaaaccccacgcgcttggaagcgcaggatgggaaaagaaggtggcgaccttccccaccctttaatctggggcctgaactggagactagctgtgaatctccagcagagggactagtggttagaggagaccccccggaaaacgcaaaacagcatattgacgctgggaaagaccagagactccatgagtttccaccacgctggccgccaggcacagatcgccgaacagcggcggccagtgtggg

SEQ ID NO: 84 - DNA, 10254 bp, Zika virus
  Strain MR 766 polyprotein gene, complete cds
atgaaaaacccaaagaagaaatccggaggattccggattgtcaatatgctaaaacgcggagtagcccgtgtaaaccccttgggaggtttgaagaggctgccagccggacttctgctgggtcatggacccatcagaatggttttggcgatattagcctttttgagattcacagcaatcaagccatcactgggcctcatcaacagatggggtaccgtggggaaaaaagaggctatggaaataataaaaaaatttaagaaagatcttgctgccatgttgagaataatcaatgctaggaaggagaggaagagacgtggcgcagacaccagcatcggaatcgttggcctcctgttgactacagccatggcagcagagatcactagacgtgggagtgcatactacatgtacttggataggagcgatgcagggaaggccatttctttcgctaccacattgggggtgaacaaatgccatgtgcagatcatggacctcgggcacatgtgtgacgccaccatgagctatgaatgccctatgctggacgagggggtggaaccagatgacgtcgattgctggtgcaacacgacatcaacttgggttgtgtacggaacctgtcatcataaaaaaggtgaagcacggcgatctagaagagccgtcacgctcccatctcactccacaaggaaattgcaaacgcggtcgcagacttggctagaatcaagagaatacacaaagcacctgatcaaggttgaaaattggatattcaggaaccctggttttacgctagtggctgtcgccatcgcctggcttttgggaagctcgacgagccaaaaagtcatatacttggtcatgatactgctgattgccccggcatacagtatcaggtgcataggagtcagcaatagagacttcgtggagggcatgtcaggtgggacctgggttgacgttgtcctggaacatggaggctgcgtcaccgtgatggcacaggacaagccaacagttgacatagagctggtcacaacaacggttagtaacatggccgaggtgagatcctattgttacgaggcatcaatatcggacatggcttcggacagtcgctgcccaacacaaggtgaagcctaccttgacaagcaatcagacactcaatatgtttgcaaaagaacattggtggacagaggttggggaaatgggtgtggactctttggcaaagggagtttggtgacatgtgctaagttcacgtgctccaagaagatgactgggaagagcattcagccggagaacctggagtatcggataatgctatcagtgcatggctcccagcacagtgggatgattgttaatgatgaaaacagagcgaaggtcgaggttacgcccaattcaccaagagcagaagcaaccctgggaggctttggaagcttaggacttgattgtgaaccaaggacaggccttgacttttcagatctgtattacctaaccatgaataacaagcattggttggtgcacaaagagtggtttcatgacatcccattgccctggcatgctggggcagacactggaactccacattggaacaacaaggaggcattagtggaattcaaggacgcccacgccaagaggcaaaccgtcgtggttttggggagccaggaaggagccgtccacacggctcttgctggagctctagaggctgagatggatggtgcaaagggaaggctattctctggccacttgaaatgtcgcttaaaaatggacaagcttagattgaagggcgtgtcatattccttgtgcaccgcggcattcacattcaccaaggtcccggctgaaacactacatggaacagtcacagtggaggtgcagtatgcagggacagatggaccctgcaaggtcccagcccagatggcggtggacatgcagaccttgaccccagtcggaaggctgataaccgccaaccccgtgattactgaaagcactgagaattcaaagatgatgttggagctcgacccaccatttggggattcttacattgtcataggagttggggataagaaaatcacccatcactggcataggagtggcagcaccattggaaaagcatttgaagccactgtgagaggcgctaagagaatggcagtcctgggggacacagcttgggactttggatcagtcggaggtgtgtttaactcattgggcaagggcattcatcagatttttggagcagctttcaaatcactgtttggaggaatgtcctggttctcacagatcctcataggcactctgctggtgtggttaggtctgaacacaaagaatgggtctatctccctcacatgcttagccctggggggagtgatgatcttcctctccacggctgtttctgctgacgtggggtgctcggtggacttctcaaaaaaagaaacgagatgtggcacgggggtgttcgtctacaatgacgttgaagcctggagggaccggtacaagtaccatcctgactcccctcgtagactggcagcagccgttaagcaagcttgggaagaggggatttgtgggatctcctctgtttctagaatggaaaacataatgtggaaatcagtggaaggagagctcaatgcaatcctagaggagaatggagtccaactgacagttgttgtgggatctgtaaaaaaccccatgtggagaggcccacaaagattgccagtgcctgtgaatgagctgccccatggctggaaagcctgggggaaatcgtactttgttagggcggcaaagaccaacaacagttttgttgtcgacggtgacacattgaaggaatgtccgctcaagcacagagcatggaacagcttcctcgtggaggatcacgggtttggggtcttccacaccagtgtttggcttaaggttagagaagattactcactggagtgtgacccagccgtcataggaacagctgttaagggaaaggaggccgcgcacagtgatctaggctattggattgaaagtgaaaagaatgacacatggaggctgaagagggctcatttgattgagatgaaaacatgtgagtggccaaagtctcacacactgtggacagatggagtggaagaaagtgatctgatcatacccaagtctttagctggtccactcagccaccacaacaccagagagggttacagaactcaagtgaaagggccatggcatagtgaggagcttgaaatccgatttgaggaatgtccaggtaccaaggttcatgtggaggagacatgcggaacgagaggaccatctctgagatcaaccactgcaagcggaagggtcattgaggaatggtgctgtagggaatgcacaatgcccccactatcgttccgagcaaaagatggctgctggtatggaatggagataaggcctaggaaagaaccagagagcaacttagtgaggtcaatggtgacagcgggatcaaccgatcatatggatcatttttctcttggagtgcttgtgattctactcatggtgcaggaagggttgaagaagagaatgaccacaaagatcatcatgagcacatcaatggcagtgctggtggccatgatcttgggaggattctcaatgagtgacctggctaagcttgtgatcctgatgggggccactttcgcagaaatgaacactggaggagacgtagctcacttggcattagtagcggcatttaaagtcagaccagccttgctggtctcatttatcttcagagccaactggacacctcgtgagagcatgctgctagccttggcttcgtgtcttctgcaaactgcgatctccgctcttgaaggcgacttgatggtcctcgttaatggatttgctttggcctggttggcaatacgtgcaatggccgtgccacgcactgacaacatcgctctagcaattctggctgctctaacaccactagcccgaggcacactgctcgtggcatggagagcgggcctcgccacttgtggagggttcatgctcctctccctgaaagggaaaggtagtgtgaagaagaacctgccattcgtcgcggccttgggattgaccgctgtgagaatagtggaccccattaatgtggtgggactactgttactcacaaggagtgggaagcggagctggccccctagtgaagtgctcactgctgtcggcctgatatgtgcattggccggagggtttgccaaggcagacatagagatggctgggcccatggcggcagtgggcctgctaattgtcagttatgtggtctcgggaaagagtgtagatatgtacattgaaagagcaggtgacatcacatgggagaaagacgcggaagtcactggaaacagtcctcggcttgacgtggcactagatgagagtggtgatttctctctggtggaggaagatggtccacccatgagagagatcatacttaaggtggtcttgatggccatctgtggcatgaacccaatagccataccttttgctgcaggagcgtggtatgtgtatgtgaagactgggaaaaggagtggtgccctctgggacgtgcctgctccgaaagaagtgaaaaaaggagagaccacagatggagtgtacagagtgatgactcgcagactgctgggttcaacacaagttggagtgggagtcatgcaggagggagtcttccacaccatgtggcacgtcacaaaaggggccgcattgaggagcggtgaagggagacttgatccatactggggggatgtcaagcaggacttggtgtcatattgtgggccttggaagctggacgcagcttgggacggagttagtgaggtgcagcttctggccgtaccccctggagagagagccagaaacattcagactctgcctggaatatttaagacaaaggatggggacatcggagcagttgctttggactatcctgcaggaacctcaggatctccgatcctagacaaatgcgggagagtgataggactctatggcaatggggttgtgatcaagaacggaagctatgttagtgctataacccagggaaagagggaggaggagactccggttgagtgttttgaaccctcgatgctgaagaagaagcagctaactgtcctggacctgcatccaggggctgggaaaaccaggagagttcttcctgaaatagtccgtgaagctataaagaagagactccgcacggtgatcttggcaccaaccagggtcgtcgctgctgagatggaggaagccctgagaggacttccggtgcgttacatgacaacagcagtcaaggtcacccattctgggacagaaatcgttgatttgatgtgccatgccaccttcacttcacgcctactacaacccattagagtccctaattacaacctctacatcatggatgaagcccatttcacagacccctcaagcatagctgcaagaggatatatatcaacaagggttgagatgggcgaggcagcagccatctttatgactgccacaccaccaggaacccgcgatgcgtttccagattccaactcaccaatcatggacacagaagtggaagtcccagagagagcctggagctcaggctttgattgggtgacggaccattctgggaaaacagtttggttcgttccaagcgtgaggaatggaaatgaaatcgcagcctgtctgacaaaggctggaaagcgggttatacagcttagtaggaaaacttttgagacagagtttcagaaaacaaaaaatcaagagtgggactttgtcataacaactgacatctcagagatgggtgccaacttcaaggctgaccgggttatagattccaggagatgcctaaagccagttatacttgatggtgagagagtcatcttggctgggcccatgcctgtcacgcatgctagcgctgctcagaggagaggacgtataggcaggaaccccaacaagcctggagatgagtacatgtatggaggtgggtgtgcggagactgatgaagaccatgcacattggcttgaagcaagaatgcttcttgacaacatttacctccaggatggcctcatagcctcgctctatcgacctgaggccgacaaggtagccgccattgagggagagtttaagctgaggacagagcaaaggaagacctttgtggaactcatgaagagaggagatcttcccgtttggttggcctaccaggttgcatctgccggaataacttatacagacagaagatggtgttttgatggcacaaccaacaacaccataatggaagacagtgtaccagcagaggtgtggaccaagtatggagagaagagagtgctcaaaccaagatggatggacgccagggtctgctcagatcatgcggccctgaagtcgttcaaagaattcgccgctgggaaaagaggagcggctttgggagtaatggaggccctgggaacattaccaggacacatgacagagaggtttcaggaagccattgataacctcgctgtgctcatgcgagcagagactggaagcaggccctacaaggcagcggcagcccaattgccggagaccctagagaccatcatgcttttaggcctgctgggaacagtatcgctggggatcttttttgtcttgatgaggaacaagggcatcgggaagatgggctttgaaatggtaacccttggggccagcgcatggctcatgtggctctcagaaatcgaaccagccagaattgcatgtgtccttattgttgtgtttttattactggtggtgctaataccagagccagagaagcaaagatccccccaggacaatcagatggcaatcattattatggtggcagtgggccttttggggttgataactgcaaatgaacttggatggctggagagaacaaaaaatgacatagctcatctgatgggaaagagagaagagggaacaaccgtgggattctcaatggacatcgatctgcgaccagcctccgcatgggctatttatgccgcattgacaaccctcatcaccccagccgtccagcacgcggtaactacctcgtacaacaactactccttaatggcgatggccacacaagctggagtgctgtttggcatgggcaaagggatgccattttatgcatgggacttaggagtcccgttgctaatgatgggctgctactcacaactaacacccctgaccctgatagtagccatcattttgcttgtggcacattacatgtacttgatcccaggcctacaggcagcagcagcacgcgctgcccagaagagaacagcagccggcatcatgaagaatcccgttgtggatggaatagtggtaactgacattgacacaatgacaattgacccccaagtggagaagaagatgggacaagtgctacttatagcagtggctgtctccagtgctgtgttgctgcggaccgcttggggatggggggaggctggagctttgatcacagcagcaacttccaccctgtgggaaggctccccaaacaaatactggaactcctccacagccacctcactgtgcaacatcttcagaggaagttacttggcaggagcttcccttatttacacagtgacaagaaatgccggcctggttaagagacgtggaggtggaacgggagaaactctgggagagaagtggaaagcccgcctgaatcagatgtcggccttggagttctactcttacaaaaagtcaggcatcactgaagtatgtagagaggaggctcgccgcgccctcaaggatggagtggccacaggaggacatgctgtatcccgaggaagcgcaaaactcagatggttggtggagagaggatatctgcagccctatggaaaggttgttgatctcggatgcggcagagggggctggagttattatgccgccaccatccgcaaagtgcaggaggtgagaggatacacaaagggaggtcccggtcatgaagagcccatgctggtgcaaagctatgggtggaacataattcgtctcaagagtggagtggacgtcttccacatggcggctgagtcgtgtgacactttgctgtgtgacataggtgagtcatcatccagtcctgaagtggaggagacgcgaacactcagagtgctctccatggtgggggactggcttgagaagagaccaggggccttctgcataaaggtgttatgcccatacaccagcaccatgatggagaccatggagcgactgcaacgtaggtatgggggaggactagtcagagtgccactgtcccgcaattctacacatgagatgtattgggtctctggagcaaaaagtaacatcataaaaagtgtgtccaccacaagtcagctcctcctgggacgcatggatgggcccaggaggccagtgaagtatgaggaggatgtgaacctcggctcaggcacacgagctgtggcaagctgtgctgaggctcccaacatgaaggtcattggtaggcgcattgagagaatccgtagtgaacatgcagaaacatggttctttgatgaaaaccatccatacaggacatgggcctaccacgggagctacgaagcccccacgcaagggtcagcatcttccctcgtgaatggggttgttagactcctgtcaaagccctgggatgtggtgactggagttacaggaatagctatgactgacaccacaccgtacggccaacaaagagtcttcaaagaaaaagtggacaccagggtgccagaccctcaagaaggtactcgccaggtaatgaacatggtcgcttcctggctgtggaaggagctgggaaaacgtaagcggccacgtgtctgcaccaaagaagagttcatcaacaaggtgcgcagcaatgcagcactgggagcaatatttgaagaggaaaaagaatggaagacggctgtggaagctgtgaatgatccaaggttttgggccctagtggataaggaaagagaacaccacctgagaggagagtgccatagttgtgtgtacaacatgatgggaaaaagagaaaagaagcaaggggaattcgggaaagcaaaaggcagtcgcgccatctggtacatgtggttgggagccagattcttggagtttgaagcccttggattcttgaacgaggaccattggatgggaagagaaaactcaggaggtggtgtcgaagggttgggactgcaaagacttggatacgttctagaagaaatgagccgggcaccaggaggaaagatgtatgcagatgacaccgctggctgggacacccgcattagcaagtttgatttggagaatgaagccttgattactaaccaaatggatgaagggcacagaactctggcgttggccgtgattaagtacacataccaaaacaaagtggtgaaggtcctcagaccagctgaaggaggaaaaacagtcatggacatcatttcaagacaagaccagagggggagcggacaagttgtcacttatgctctcaacacatttaccaacttggtggtgcagctcatccggaacatggaggctgaggaagtgttagagatgcaagacttatggctgttgaggaagccagagaaagtaaccagatggctgcagagtagcggatgggacagactcaaacgaatggcagtcagtggtgatgactgtgttgtaaagccaattgatgacaggtttgcacacgccctcaggttcttgaatgatatggggaaagttaggaaagacacacaggaatggaaaccctcaactggatggagcaactgggaagaagtcccgttctgctcccaccactttaacaagctgcacctcaaagacgggagatccattgtggtcccttgccgccaccaagatgaactgattggccgggctcgcgtttcgccgggggcaggatggagcatccgggagactgcctgtcttgcaaaatcatatgcacagatgtggcagcttctttatttccacagaagagacctccgactgatggccaatgccatttgctcggccgtgccagttgactgggtcccaactgggagaactacctggtcaatccatggaaagggagaatggatgactactgaggacatgctcatggtgtggaatagagtgtggattgaggagaatgatcacatggaggacaagacccctgtaacaaaatggacagacattccctatttgggaaaaagggaggacttatggtgtggatcccttataggacacagacctcgcaccacttgggctgagaacatcaaagacacagtcagcatggtgcgcagaatcataggtgatgaagaaaagtacatggactacctatccactcaagttcgctacttgggtgaggaagggtctacacctggagtgctgtaa

SEQ ID NO: 85 - DNA, 10793 bp, Zika virus
  Isolate Brazil-ZKV2015, complete genome
ccaatctgtgaatcagactgcgacagttcgagtttgaagcgaaagctagcaacagtatcaacaggttttattttggatttggaaacgagagtttctggtcatgaaaaacccaaaaaagaaatccggaggattccggattgtcaatatgctaaaacgcggagtagcccgtgtgagcccctttgggggcttgaagaggctgccagccggacttctgctgggtcatgggcccatcaggatggtcttggcgattctagcctttttgagattcacggcaatcaagccatcactgggtctcatcaatagatggggttcagtggggaaaaaagaggctatggaaataataaagaagttcaagaaagatctggctgccatgctgagaataatcaatgccaggaaggagaagaagagacgaggcgcagatactagtgtcggaatcgttggcctcctgctgaccacagctatggcagcggaggtcactagacgtgggagtgcatactatatgtacttggacagaaacgatgctggggaggccatatcttttccaaccacattggggatgaataagtgttatatacagatcatggatcttggacacatgtgtgatgccaccatgagctatgaatgccctatgctggatgagggggtggaaccagatgacgtcgattgttggtgcaacacgacgtcaacttgggttgtgtacggaacctgccatcacaaaaaaggtgaagcacggagatctagaagagctgtgacgctcccctcccattccactaggaagctgcaaacgcggtcgcaaacctggttggaatcaagagaatacacaaagcacttgattagagtcgaaaattggatattcaggaaccctggcttcgcgttagcagcagctgccatcgcttggcttttgggaagctcaacgagccaaaaagtcatatacttggtcatgatactgctgattgccccggcatacagcatcaggtgcataggagtcagcaatagggactttgtggaaggtatgtcaggtgggacttgggttgatgttgtcttggaacatgggggttgtgtcaccgtaatggcacaggacaaaccgactgtcgacatagagctggttacaacaacagtcagcaacatggcggaggtaagatcctactgctatgaggcatcaatatcagacatggcttcggacagccgctgcccaacacaaggtgaagcctaccttgacaagcaatcagacactcaatatgtctgcaaaagaacgttagtggacagaggctggggaaatggatgtggactttttggcaaagggagcctggtgacatgcgctaagtttgcatgctccaagaaaatgaccgggaagagcatccagccagagaatctggagtaccggataatgctgtcagttcatggctcccagcacagtgggatgatcgttaatgacacaggacatgaaactgatgagaatagagcgaaggttgagataacgcccaattcaccaagagccgaagccaccctggggggttttggaagcttaggacttgattgtgaaccgaggacaggccttgacttttcagatttgtattacttgactatgaataacaagcactggttggttcacaaggagtggttccacgacattccattaccttggcacgctggggcagacaccggaactccacactggaacaacaaagaagcactggtagagttcaaggacgcacatgccaaaaggcaaactgtcgtggttctagggactcaagaaggagcagttcacacggcccttgctggagctctggaggctgagatggatggtgcaaagggaaggctgtcctctggccacttgaaatgtcgcctgaaaatggataaacttagattgaagggcgtgtcatactccttgtgtaccgcagcgttcacattcaccaagatcccggctgaaacactgcacgggacagtcacagtggaggtacagtacgcagggacagatggaccttgcaaggttccagctcagatggcggtggacatgcaaactctgaccccagttgggaggttgataaccgctaaccccgtaatcactgaaagcactgagaactctaagatgatgctggaacttgatccaccatttggggactcttacattgtcataggagtcggggagaagaagatcacccaccactggcacaggagtggcagcaccattggaaaagcatttgaagccactgtgagaggtgccaagagaatggcagtcttgggagacacagcctgggactttggatcagttggaggcgctctcaactcattgggcaagggcatccatcaaatttttggagcagctttcaaatcattgtttggaggaatgtcctggttctcacaaattctcattggaacgttgctgatgtggttgggtctgaacacaaagaatggatctatttcccttatgtgcttggccttagggggagtgttgatcttcttatccacagccgtctctgctgatgtggggtgctcggtggacttctcaaagaaggagacgagatgtggtacaggggtgttcgtctataacgacgttgaagcctggagggacaggtacaagtaccatcctgactctccccgtagattggcagcagcagtcaagcaagcctgggaagatggtatctgcgggatctcctctgtttcaagaatggaaaacatcatgtggagatcagtagaaggggagcttaacgcaatcctggaagagaatggagttcaactgacggtcgttgtgggatctgtaaaaaaccccatgtggagaggtccacagagattgcccgtgcctgtgaacgagctgccccacggctggaaggcttgggggaaatcgtacttcgtcagagcagcaaagacaaataacagctttgtcgtggatggtgacacactgaaggaatgcccactcaaacatagagcatggaacagctttcttgtggaggatcatgggttcggggtatttcacactagtgtctggctcaaggttagagaagattattcattagagtgtgatccagccgttattggaacagctgttaagggaaaggaggctgtacacagtgatctaggctactggattgagagtgagaagaatgacacatggaggctgaagagggcccatctgatcgagatgaaaacatgtgaatggccaaagtcccacacattgtggacagatggaatagaagagagtgatctgatcatacccaagtctttagctgggccactcagccatcacaataccagagagggctacaggacccaaatgaaagggccatggcacagtgaagagcttgaaattcggtttgaggaatgcccaggcactaaggtccacgtggaggaaacatgtggaacaagaggaccatctctgagatcaaccactgcaagcggaagggtgatcgaggaatggtgctgcagggagtgcacaatgcccccactgtcgttccgggctaaagatggctgttggtatggaatggagataaggcccaggaaagaaccagaaagcaacttagtaaggtcaatggtgactgcaggatcaactgatcacatggatcacttctcccttggagtgcttgtgattctgctcatggtgcaggaagggctgaagaagagaatgaccacaaagatcatcataagcacatcaatggcagtgctggtagctatgatcctgggaggattttcaatgagtgacctggctaagcttgcaattttgatgggtgccaccttcgcggaaatgaacactggaggagatgtagctcatctggcgctgatagcggcattcaaagtcagaccagcgttgctggtatctttcatcttcagagctaattggacaccccgtgaaagcatgctgctggccttggcctcgtgttttttgcaaactgcgatctccgccttggaaggcgacctgatggttctcatcaatggttttgctttggcctggttggcaatacgagcgatggttgttccacgcactgacaacatcaccttggcaatcctggctgctctgacaccactggcccggggcacactgcttgtggcgtggagagcaggccttgctacttgcggggggtttatgctcctctctctgaagggaaaaggcagtgtgaagaagaacttaccatttgtcatggccctgggactaaccgctgtgaggctggtcgaccccatcaacgtggtgggactgctgttgctcacaaggagtgggaagcggagctggccccctagcgaagtactcacagctgttggcctgatatgcgcattggctggagggttcgccaaggcagatatagagatggctgggcccatggccgcggtcggtctgctaattgtcagttacgtggtctcaggaaagagtgtggacatgtacattgaaagagcaggtgacatcacatgggaaaaagatgcggaagtcactggaaacagtccccggctcgatgtggcgctagatgagagtggtgacttctccctggtggaggatgacggtccccccatgagagagatcatactcaaggtggtcctgatgaccatctgtggcatgaacccaatagccataccctttgcagctggagcgtggtacgtatacgtgaagactggaaaaaggagtggtgctctatgggatgtgcctgctcccaaggaagtaaaaaagggggagaccacagatggagtgtacagagtaatgactcgtagactgctaggttcaacacaagttggagtgggagttatgcaagagggggtctttcacactatgtggcacgtcacaaaaggatccgcgctgagaagcggtgaagggagacttgatccatactggggagatgtcaagcaggatctggtgtcatactgtggtccatggaagctagatgccgcctgggacgggcacagcgaggtgcagctcttggccgtgccccccggagagagagcgaggaacatccagactctgcccggaatatttaagacaaaggatggggacattggagcggttgcgctggattacccagcaggaacttcaggatctccaatcctagacaagtgtgggagagtgataggactttatggcaatggggtcgtgataaaaaatgggagttatgttagtgccatcacccaagggaggagggaggaagagactcctgttgagtgcttcgagccttcgatgctgaagaagaagcagctaactgtcttagacttgcatcctggagctgggaaaaccaggagagttcttcctgaaatagtccgtgaagccataaaaacaagactccgtactgtgatcttagctccaaccagggttgtcgctgctgaaatggaggaagcccttagagggcttccagtgcgttatatgacaacagcagtcaatgtcacccactctggaacagaaatcgtcgacttaatgtgccatgccaccttcacttcacgtctactacagccaatcagagtccccaactataatctgtatattatggatgaggcccacttcacagatccctcaagcatagcagcaagaggatacatttcaacaagggttgagatgggcgaggcggctgccatcttcatgaccgccacgccaccaggaacccgtgacgcatttccggactccaactcaccaattatggacaccgaagtggaagtcccagagagagcctggagctcaggctttgattgggtgacggatcattctggaaaaacagtttggtttgttccaagcgtgaggaacggcaatgagatcgcagcttgtctgacaaaggctggaaaacgggtcatacagctcagcagaaagacttttgagacagagttccagaaaacaaaacatcaagagtgggactttgtcgtgacaactgacatttcagagatgggcgccaactttaaagctgaccgtgtcatagattccaggagatgcctaaagccggtcatacttgatggcgagagagtcattctggctggacccatgcctgtcacacatgccagcgctgcccagaggagggggcgcataggcaggaatcccaacaaacctggagatgagtacctgtatggaggtgggtgcgcagagactgacgaagaccatgcacactggcttgaagcaagaatgctccttgacaatatttacctccaagatggcctcatagcctcgctctatcgacctgaggccgacaaagtagcagccattgagggagagttcaagcttaggacggagcaaaggaagacctttgtggaactcatgaaaagaggagatcttcctgtttggctggcctatcaggttgcatctgccggaataacctacacagatagaagatggtgctttgatggcacgaccaacaacaccataatggaagacagtgtgccggcagaggtgtggaccagacacggagagaaaagagtgctcaaaccgaggtggatggacgccagagtttgttcagatcatgcggccctgaagtcattcaaggagtttgccgctgggaaaagaggagcggcttttggagtgatggaagccctgggaacactgccaggacacatgacagagagattccaggaagccattgacaacctcgctgtgctcatgcgggcagagactggaagcaggccttacaaagccgcggcggcccaattgccggagaccctagagaccattatgcttttggggttgctgggaacagtctcgctgggaatctttttcgtcttgatgaggaacaagggcatagggaagatgggctttggaatggtgactcttggggccagcgcatggctcatgtggctctcggaaattgagccagccagaattgcatgtgtcctcattgttgtgttcctattgctggtggtgctcatacctgagccagaaaagcaaagatctccccaggacaaccaaatggcaatcatcatcatggtagcagtaggtcttctgggcttgattaccgccaatgaactcggatggttggagagaacaaagagtgacctaagccatctaatgggaaggagagaggagggggcaaccataggattctcaatggacattgacctgcggccagcctcagcttgggccatctatgctgccttgacaactttcattaccccagccgtccaacatgcagtgaccacttcatacaacaactactccttaatggcgatggccacgcaagctggagtgttgtttggtatgggcaaagggatgccattctacgcatgggactttggagtcccgctgctaatgataggttgctactcacaattaacacccctgaccctaatagtggccatcattttgctcgtggcgcactacatgtacttgatcccagggctgcaggcagcagctgcgcgtgctgcccagaagagaacggcagctggcatcatgaagaaccctgttgtggatggaatagtggtgactgacattgacacaatgacaattgacccccaagtggagaaaaagatgggacaggtgctactcatagcagtagccgtctccagcgccatactgtcgcggaccgcctgggggtggggggaggctggggccctgatcacagccgcaacttccactttgtgggaaggctctccgaacaagtactggaactcctctacagccacttcactgtgtaacatttttaggggaagttacttggctggagcttctctaatctacacagtaacaagaaacgctggcttggtcaagagacgtgggggtggaacaggagagaccctgggagagaaatggaaggcccgcttgaaccagatgtcggccctggagttctactcctacaaaaagtcaggcatcaccgaggtgtgcagagaagaggcccgccgcgccctcaaggacggtgtggcaacgggaggccatgctgtgtcccgaggaagtgcaaagctgagatggttggtggagcggggatacctgcagccctatggaaaggtcattgatcttggatgtggcagagggggctggagttactacgccgccaccatccgcaaagttcaagaagtgaaaggatacacaaaaggaggccctggtcatgaagaacccgtgttggtgcaaagctatgggtggaacatagtccgtcttaagagtggggtggacgtctttcatatggcggctgagccgtgtgacacgttgctgtgtgacataggtgagtcatcatctagtcctgaagtggaagaagcacggacgctcagagtcctctccatggtgggggattggcttgaaaaaagaccaggagccttttgcataaaagtgttgtgcccatacaccagcactatgatggaaaccctggagcgactgcagcgtaggtatgggggaggactggtcagagtgccactctcccgcaactctacacatgagatgtactgggtctctggagcgaaaagcaacaccataaaaagtgtgtccaccacgagccagctcctcttggggcgcatggacgggcctaggaggccagtgaaatatgaggaggatgtgaatctcggctctggcacgcgggctgtggtaagctgcgctgaagctcccaacatgaagatcattggtaaccgcattgaaaggatccgcagtgagcacgcggaaacgtggttctttgacgaaaaccacccatataggacatgggcttaccatggaagctatgtggcccccacacaagggtcagcgtcctctctaataaacggggttgtcaggctcctgtcaaaaccctgggatgtggtgactggagtcacaggaatagccatgaccgacaccacaccgtatggtcagcaaagagttttcaaggaaaaagtggacactagggtgccagacccccaagaaggcactcgtcaggttatgagcatggtctcttcctggttgtggaaagagctaggcaaacacaaacgaccacgagtctgtaccaaagaagagttcatcaacaaggttcgtagcaatgcagcattaggggcaatatttgaagaggaaaaagagtggaagactgcagtggaagctgtgaacgatccaaggttctgggctctagtggacaaggaaagagagcaccacctgagaggagagtgccagagttgtgtgtacaacatgatgggaaaaagagaaaagaaacaaggggaatttggaaaggccaagggcagccgcgccatctggtatatgtggctaggggctagatttctagagttcgaagcccttggattcttgaacgaggatcactggatggggagagagaactcaggaggtggtgttgaagggctgggattacaaagactcggatatgtcctagaagagatgagtcgcataccaggaggaaggatgtatgcagatgacactgctggctgggacacccgcatcagcaggtttgatctggagaatgaagctctaatcaccaaccaaatggagaaagggcacagggccttggcattggccataatcaagtacacataccaaaacaaagtggtaaaggtccttagaccagctgaaaaagggaaaacagttatggacattatttcgagacaagaccaaagggggagcggacaagttgtcacttacgctcttaacacatttaccaacctagtggtgcaactcattcggaatatggaggctgaggaagttctagagatgcaagacttgtggctgctgcggaggtcagagaaagtgaccaactggttgcagagcaacggatgggataggctcaaacgaatggcagtcagtggagatgattgcgttgtgaagccaattgatgataggtttgcacatgccctcaggttcttgaatgatatgggaaaagttaggaaggacacacaagagtggaaaccctcaactggatgggacaactgggaagaagttccgttttgctcccaccacttcaacaagctccatctcaaggacgggaggtccattgtggttccctgccgccaccaagatgaactgattggccgggcccgcgtctctccaggggcgggatggagcatccgggagactgcttgcctagcaaaatcatatgcgcaaatgtggcagctcctttatttccacagaagggacctccgactgatggccaatgccatttgttcatctgtgccagttgactgggttccaactgggagaactacctggtcaatccatggaaagggagaatggatgaccactgaagacatgcttgtggtgtggaacagagtgtggattgaggagaacgaccacatggaagacaagaccccagttacgaaatggacagacattccctatttgggaaaaagggaagacttgtggtgtggatctctcatagggcacagaccgcgcaccacctgggctgagaacattaaaaatacagtcaacatggtgcgcaggatcataggtgatgaagaaaagtacatggactacctatccacccaagttcgctacttgggtgaagaagggtctacacctggagtgctgtgagcaccaatcttaatgttgtcaggcctgctagtcagccacagcttggggaaagctgtgcagcctgtgacccctccaggagaagctgggtaaccaagcctatagtcaggccgagaacgccatggcacggaagaagccatgctgcctgtgagcccctcagaggacactgagtcaaaaaaccccacgcgcttggaggcgcaggatgggaaaagaaggtggcgaccttccccacccttcaatctggggcctgaactggagatcagctgtggatctccagaagagggactagtggttagaggagaccccccggaaaacgcaaaacagcatattgacgctgggaaagaccagagactccatgagtttccaccacgctggccgccaggcacagatcgccgaatagcggcggccggtgtggggaaatcca

SEQ ID NO: 86 - DNA, 10290 bp, Spondweni virus
  Strain SM-6 V-1 polyprotein gene, complete cds
atgaaaaacccaaaaagagccggtagcagccggcttgtcaatatgctaagacgcggtgcagcccgtgtcatccctccaggaggagggctcaagaggctgcctgtaggattgctgttgggtcggggtccgatcaaaatgatcctggccatactggcattcctacgatttacagcaataaaaccgtccactggcctcatcaacagatggggaaaagtgggcaaaaaagaggccatcaaaatcctcacaaaattcaaggctgacgtgggcaccatgctgcgtatcatcaacaatcggaagacaaaaaagagaggagtcgaaactggaattgtgttcctggcattgctggtgtctattgttgctgtggaagtcacaaaaaagggggacacctattacatgtttgcggacaagaaggacgccggaaaggtggtgacctttgagactgaatctggacccaaccgttgctccatccaagcaatggacattggacatatgtgtccagctacaatgagctatgaatgtcccgtgctggaaccacagtatgagccagaggatgtcgactgttggtgcaactcgacagcagcatggattgtgtatggcacatgcacccacaagacaacgggagagacaagacgttccagacgttcaatcaccctgccatctcatgcctcacaaaagttggagaccagatcatcgacgtggcttgaatcccgcgaatactccaaatatctaataaaggtggaaaactggatcctccgcaatccaggatatgcgttggtggctgcagtgattggatggactctgggcagcagtcgcagccagaagatcatctttgtcactctgctcatgttggtagcccccgcatacagcatcagatgcattggaattggaaacagagacttcattgagggaatgtccggtggcacctgggtggacattgtcctggaacatggtggttgtgtgacagtaatgtcaaacgacaaacccacattggactttgaactggtgacaacgaccgcaagtaacatggctgaggtcaggtcctactgctatgaagctaacatatccgagatggcatcggacagcaggtgccccacacagggggaagcttatcttgacaaaatggccgactcccagtttgtgtgcaagcgtgggtacgttgacaggggctggggaaacggatgtggactctttggaaaaggaagcattgtcacttgcgctaagttcacgtgtgtgaaaaagctcacagggaaaagcattcaaccggagaatctcgagtaccgggtccttgtttcggtgcacgcttcccaacatggaggaatgattaacaatgacaccaatcaccaacacgacaaggagaacagagcgcgcattgatatcacagctagcgctccccgtgttgaggtggaacttggctcctttggatccttctcgatggagtgtgaaccccggtcaggattgaactttggtgacctgtattacctcaccatgaacaacaagcattggctggttaatagagattggtttcacgatctttccttgccatggcatacaggagccacatcaaacaatcatcactggaacaacaaggaggcgctggtagaattcagagaagcccacgcaaagaagcagacggctgtggtcctgggaagtcaggaaggagctgttcacgcagcactggccggcgcactggaggctgagtctgatggacacaaagcgactatctactctggacacttgaagtgtcgcttgaagctagacaaactgcgcctgaagggaatgtcatatgcactctgcacaggagcattcaccttcgctcgcaccccctctgaaacaattcacggcaccgccacagtggagctgcaatatgcaggtgaagatgggccgtgcaaagttcccatagtaattaccagtgacaccaatagcatggcctcgacaggcaggctgatcacagcgaatccggtggtcacggaaagtggagcaaactcaaagatgatggtcgagattgaccctccgtttggtgattcttacattattgtgggcactggcacaacaaaaattacccaccattggcacagagccggtagttcaattggacgtgcatttgaggctaccatgagaggagcaaaacggatggcggtcctcggcgacaccgcttgggactttggctctgttgggggcatgttcaactccgttggaaagtttgtccaccaggtgtttggatcagcatttaaggcattgtttggaggcatgtcctggttcacacagctcctgataggatttctgctcatatggatgggtttgaacgcacgcggtggaaccgtggccatgagcttcatgggcattggggctatgctgattttcctagccacctcggtgtcaggagacacaggatgctcggttgacatatccagaagggaaatgcggtgcgggagcggcatattcgtgtacaatgacgttgacgcatggcgaagccgctacaaataccatcctgaaacccccagagctttggccgctgccgtgaaaacggcttgggaagaagggacctgtggcattacctcagtgagcagaatggaaaacctgatgtggagctctgtggctggagagttgaatgcaatccttgaggacaattcagtgccattgacagtcgtcgttggcgagccaaaatatccactgtacaatgctccaaagaggctgaaaccaccagcatcagagttaccgcaggggtggaagtcctggggaaagtcatactttgtctcagccgcaaaaaacaacaactcctttgtggtagatggtgacaccatgaaggaatgcccaagacagaagcgagcatggaacagcttgagaatagaggatcatgggttcggagtcttccacactagcatctggctgaaattccatgaggacaactccaccgaatgtgacacagctatcataggaacggcggttcgcgggaaggaagccgttcatagtgacttgggctactggatagagagtgagcgcaatgacacatggaggctctctcgagcgcacctgatcgaagcaaagacatgtgaatggccacggtcgcacacactgtggacggacggagtggaagagagcgagctgatcattccacgtggcttagccggtcctttcagccatcataacacgcgtgctggctacaagactcagaataaaggtccctggcatttaggtgatgttgaaattcagttcgccacgtgccccggaacaaccgtggtccaggaccaagagtgcagggacaggggcgcttctctacgcacgaccacagctagtggaagggtaatcaatgaatggtgctgcaggtcgtgcaccatgcctccactcagtttcaagacaaaagatggatgttggtatgcaatggagatacgtcctgtgaaagaacaagagtcaaacctcgtgcgatcgcacgtcactgccggaagcacagaccacatggaccatttctctctcggattagtagtggtcatgttgatggtgcaagaaggtatgaagaagagaatgacatcaaaagcaataatcacctcagcggcctttctcctggcggttatgatagtgggaggtttcacgtaccaggattttgggaggctggtggtattggtgggtgctgcatttgctgagatgaacactggaggtgacgttgcgcacctggcgctggtggcagcgtttaaagtgaggccagcgatgctggtctcattcatgttcagagccttgtggacccccagggagtcactgcttttagctctggctgcctgcctcctgcaggtgtcagtgacaccactggatcattccatcatgatcgtggttgatgggattgcgctgtcctggttgtgtctgaaagccatcttggtgccgcgtaccccaaacatagcccttcctcttctcgctatgctgtcacccatgctccaaggtaccaccattgtggcatggcgagctatgatggcggccctggctgtcataaccttggcttccatgaagcatggaaggggtgtaaaaaagacgtttccctacaccatcggatgcatccttggcagcatgggcttagttgaaaacttggggttggttggcctcctcttgttgacagcctcaaaaaagaggagttggcctccgagtgaggtgatgacggctgtcggactgatctgtgcaattgtgggcggactaaccaagaccgacattgacatggcgggacccatggcagccataggactgctggtggtgagctatgtggtttctggcaagagtgtggacatgtacattgaaaaggtgtgtgacatatcatgggacaaggacgctgaaataacaggcacaagtccgcggctggatgtggctctcgacgacagtggagatttctcacttatccaggatgacgggccccccactcgagagattgtgttgaaggtgtttctgatgtgtgtttgcggtgtcagccccatagccatcccctttgcagccgctgcttggttcgtgtacattaaatcagggaaaagaagcggcgccatgtgggacattccatccccaagagaagtgaaaaaaggggaaacaacggctggagtgtacagaatcatgacgcgtaaattgctgggcagcacacaggtgggagccggagtaatgcatgaaggtgtttttcacacaatgtggcacgtcacaaaaggttcggcccttcggagtggtgagggacgcctagatccatactggggaaacgtgaagcaggatttgatctcttactgcggaccatggaaactggatgggaaatgggacggcgtgtcggaagtccaactgatagcggtcgccccaggtgagcgcgccagaaatgtgcagacaaaaccaggagtgttcaagaccactgatggggaaatcggggccttggcccttgacttcccaggcggaagttcaggctccccgataattgacaaaaatggacatgtaattggcctgtatggaaatggtgtcgtggtcaagagtggaagctacgtgagtgccatcatgcagacagagaagatggaggaacccgcagttgactgctttgaggaggacatgctgagaaaaaagaagctgacggtgctcgacctccatccaggagctggaaaaactcgaagagtgctccctcagatcgtcaaggctgcaattaagaaacgcctacgcacggtaatcctggcacccacccgagtggtggcagctgagatggctgaggcactaaaagaccttccaataaggtacatgactccggcagtttcagccacccatgatggcaatgagattgttgaccttatgtgccacgccacttttacatcaaggctaatgcaaccaattagggtgcctaattacaatctatatataatggatgaggcccacttcacagatcctgcaagcatcgctgcaagagggtacatagcaacaagagtggacatgggagacgccgcggccatcttcatgacggccacccctcctggcagcactgaagctttcccggattcaaacgcccccatcacagatgttgaaacagaggttcctgacaaggcgtggaattctggatttgaatggatcactgattacccagggaaaaccgtttggtttgtccctagtgtcagaatgggcaatgagatctcggcctgcctcacaaaagccggcaaatcggttatccaactcagccggaaaacctttgaaacagagtaccagaagacaaagaatggtgagtgggactttgtcgtgaccactgacatctcagaaatgggagccaacttcaaggccgacagagtcatagactcacggaaatgcttgaagccagtgattctggatgacatggaagagagagttgttcttgccgggccgatggcagtaacaccatccagcgcagctcaacgcagaggaagaattggaagaaaccccaacaaaactggagatgagttctattacggggggggctgtgccgcaacggatgatgaccatgctcattgggtagaggctaggatgctgcttgacaacatctacctccaggacaacctcgttgcatctctgtacaagccagaacaaggaaaggtctcggcaatagaaggggagttcaaactgagaggagaacagaggaaaaccttcgtggagctgatgaagagaggggacttgccagtgtggttgtcatatcaagtggcggcctccggactcagctatactgaccggcgctggtgctttgatggaaaaaacaacaacaccatcctggaggactgcgtccccgtcgaggtgtggacaaaatttggagagaaaaagattctgaagcccagatggatggacgctcggatctgctctgatcatgcctctttgaagtctttcaaggagtttgctgcaggaaagagaacaatagccactggcttaattgaggcttttgggatgcttcccgggcacatgactgagagattccaggaggccgtcgacaatttggccgtgttgatgagggccgaggcaggctctagggcacacagaatggctgcagcacagctccctgagacaatggaaaccatcctgctcctcagcctgctggcattcgtgtcacttggtgtattttttgtactgatgagggcaaaagggttaggaaaaatggggtccggcatgatcgtgctggcaggaagtggctggctcatgtggatgtctgaggtggaaccagcccgcatagcttgtgtggtgatcatagtgtttctgctaatggtcgttctgattccggaaccggagaagcagcgctctccccaggacaatcagctggctctaattatcttgatcgcgacgggcctcatcacgctcatcgcggccaatgagctgggttggttagaaagaacaaagagtgacctcaccaggctgttttggagagaacacgctgagccaacaggagggagagggttttccttctcgctggacattgacctgcggccggcatcggcctgggcaatatatgccgctatgacaaccctgatcacaccgacagtccaacacgctgtgaccacatcgtacaacaactactctctcatggctatggccactcaggccggagttctttttggcatgggacggggggtgcctttttacaaatgggactttggcgtgccactccttatgctgggctgctactcacaacttaccccactcaccctgatcgtggctctcgtgatgctagccgctcactatctctatctcatccccgggctccaggcaacggccgccagggccgcccaacgaaggacggctgctggaataatgaaaaacccagtggtggatggaattgtggtaactgacatagacccaatccaaatcgatccaaatgtcgaaaagaagatgggccaggtcatgctcatctttgtggctttggcgagcgcggttctcatgagaacggcatggggttggggagaggctggtgcccttgcatcggcagcagctgccaccctatgggaaggggctcccaacaagtactggaattcatcaacggctacatccttgtgcaacatatttcggggaagttatctggcaggtccctccctcatctacaccgtcacacgcaatgcaggtatcatgaagaaaaggggcggtggaaatggagaaacggtgggcgagaaatggaaggagcgcttgaatcggatgaccgcgcttgaattctacgcctacaagcggtcaggaataactgaagtgtgcagagaacccgccagaagagccttgaaggatggagtcgtcacaggaggacacgctgtctcccgcggaagcgcaaagctgcgatggatggtggaacgtggccacgtcaatctagtgggacgcgttgtcgacctcggatgtggaaggggtggctggagttactacgccgcatctcaaaagcaagtcctcgaggtgagaggctacacaaaagggggagcgggccacgaggagcccatgaatgtccaaagttatggttggaacatagtgcgactcaagagtggagtggacgttttttatctaccatcagaaccatgtgacacgctgctctgtgacattggagagtcatcctcgagcccagcagtggaagaagcccggactctgagagtgctcgggatggttgaaacctggctggaacggggcgtaaagaacttctgcatcaaagtgctctgcccgtacaccagtgccatgattgagcggctggaagccctccagcgtcgctacggaggaggcctggtgagggttccactctccagaaattccacccacgaaatgtactgggtctctggagcaaaatcaaacatcatcaggagtgtgaatgccaccagccagctgctcatgcacagaatggacatccccacgcggaaaacaaagtttgaagaagacgtcaatctggggaccggaaccagggcagttgaaagcagagctgaccctcccgacatgaaaaaactaggcagccggattgagcggttgagaaaggaatatggatccacttggcactacgatgaaaaccacccctacaggacatggcattaccacggcagttatgaggctgacacgcaaggctccgcctcctcaatggtcaacggcgtggtgcgtctcctctcaaaaccatgggatgcattgagctcggtcaccaacattgctatgacggacacaactccgtttggacagcagcgggtgttcaaggagaaagtggacacccggactccagaccccaagcagggcacgcaaagagtcatggccataacatcacaatggctgtgggaccgcctagcaagaaacaagacccctcggatgtgcacgcgacaggaattcataaacaaggtcaacagtcacgcggcgttgggacccgtttttagagaacagcagggatggggttcagcggccgaagcggtggtagatcctaggttttgggagctcgttgacaatgaaagagaagcccatttgagaggggagtgcttgacctgtgtctacaacatgatggggaaaagagaaaagaagctcggtgaattcgggaaggcaaaaggcagcagagccatttggtacatgtggctgggagcccgcttcctcgagttcgaggccctgggcttcctcaatgaagaccactggttaagcagagagaactctggagggggagttgagggcttgggcctccaaaaacttggatacatccttgaagagatcagcaggaggccaggaggcaaaatgtatgccgatgacacggctggctgggacacccgcatcacgaaatgcgacctagaaaatgaggcgcgcattttggaaaaaatggacgggatccacaaaaaactcgcacgggccgtcatcgagttgacatacaagcataaggttgtgagagtcttgagaccagcaccacaagggaaggtcgttatggacatcatctccaggccagaccaaagggggagtgggcaggtggttacttatgccctcaacacctatacaaacttggtggtgcagctgatccgtaacatggaagcagaggctgtcatcaatgaaagagacatggaggagctccaaaacccatggaaagtcatcaattggctagaaggaaatggatgggacagactccgctcgatggcagtgagtggagatgactgtgtcgtgaaaccaatggatgataggttcgcctatgcactgaatttcctcaatgacatgggcaaggtcagaaaagatgtccaggaatggaagccctcgccggggtggacaaactgggaagaagtgcccttttgctcccaccacttcaacaagctcccgatgaaggatggaagaacaataatagttccctgccggcaccaagatgagttgataggcagggctagagtttctccaggaaaaggctggtcactcagtgaaacagcatgcttgggcaagtcttatgcccagatgtggctactgttgtactttcacaggagagatctccgactcatggcaaacgcaatctgctctgctgtaccggtgagttgggtgcccacggggagaacaacctggtccatccatgggcgtggagagtggatgacaacagaggacatgctagaggtatggaacagagtgtggatcatagagaatgagtacatggaggacaagacccctgtcacagagtggaccgatgttccatacttgggaaagagagaagacttgtggtgcggctcccttattggacacaggccaagaagcacatgggcagagaacatctgggctgccatttatcaagtgcgccgagcaatcggcgaaactgaagaatatagagactacatgagcacacaggtccgctatggctcggaggaagggccaagcgctggtgtgttgtaa

SEQ ID NO: 87 - DNA, 10290 bp, Spondweni virus; identical to SEQ ID NO: 86
  Complete genome NCBI Reference Sequence: NC_029055.1

SEQ ID NO: 88 - protein, 3423 aa, Zika virus
  Isolate GD01 polyprotein
MKNPKKKSGGFRIVNMLKRGVARVSPFGGLKRLPAGLLLGHGPIRMVLAILAFLRFTAIKPSLGLINRWGSVGKKEAMEIIKKFKKDLAAMLRIINARKEKKRRGAETSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNGTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSADVGCSVDFSKKETRCGTGVFVYNDVEAWRDRYKYHPDSPRRLAAAVKQAWEDGICGISSVSRMENIMWRSVEGELNAILEENGVQLTVVVGSVKNPMWRGPQRLPVPVNELPHGWKAWGKSYFVRAAKTNNSFVVDGDTLKECPLKHRAWNSFLVEDHGFGVFHTSVWLKVREDYSLECDPAVIGTAVKGKEAVHSDLGYWIESEKNDTWRLKRAHLIEMKTCEWPKSHTLWTDGIEESDLIIPKSLAGPLSHHNTREGYRTQMKGPWHSEELEIRFEECPGTKVHVEETCGTRGPSLRSTTASGRVIEEWCCRECTMPPLSFRAKDGCWYGMEIRPRKEPESNLVRSMVTAGSTDHMDHFSLGVLVILLMVQEGLKKRMTTKIIISTSMAVLVAMILGGFSMSDLAKLAILMGATFAEMNTGGDVAHLALIAAFKVRPALLVSFIFRANWTPRESMLLALASCLLQTAISALEGDLMVLINGFALAWLAVRAMVVPRTDNITLAILAALTPLARGTLLVAWRAGLATCGGFMLLSLKGKGSVKKNLPFVMALGLTAVRLVDPINVVGLLLLTRSGKRSWPPSEVLTAVGLICALAGGFAKADIEMAGPMAAVGLLIVSYVVSGKSVDMYIERAGDITWEKDAEVTGNSPRLDVALDESGDFSLVEDDGPPMREIILKVVLMTICGMNPIAIPFAAGAWYVYVKTGKRSGALWDVPAPKEVKKGETTDGVYRVMTRRLLGSTQVGVGVMQEGVFHTMWHVTKGSALRSGEGRLDPYWGDVKQDLVSYCGPWKLDAAWDGHSEVQLLAVPPGERARNIQTLPGIFKTKDGDIGAVALDYPAGTSGSPILDKCGRVIGLYGNGVVIKNGSYVSAITQGRREEETPVECFEPSMLKKKQLTVLDLHPGAGKTRRVLPEIVREAIKTRLRTVILAPTRVVAAEMEEALRGLPVRYMTTAVNVTHSGTEIVDLMCHATFTSRLLQPIRVPNYNLYIMDEAHFTDPSSIAARGYISTRVEMGEAAAIFMTATPPGTRDAFPDSNSPIMDTEVEVPERAWSSGFDWVTDHSGKTVWFVPSVRNGNEIAACLTKAGKRVIQLSRKTFETEFQKTKHQEWDFVVTTDISEMGANFKADRVIDSRRCLKPVILDGERVILAGPMPVTHASAAQRRGRIGRNPNKPGDEYLYGGGCAETDEDHAHWLEARMLLDNIYLQDGLIASLYRPEADKVAAIEGEFKLRTEQRKTFVELMKRGDLPVWLAYQVASAGITYTDRRWCFDGTTNNTIMEDSVPAEVWTRHGEKRVLKPRWMDARVCSDHAALKSFKEFAAGKRGAAFGVMEALGTLPGHMTERFQEAIDNLAVLMRAETGSRPYKAAAAQLPETLETIMLLGLLGTVSLGIFFVLMRNKGIGKMGFGMVTLGASAWLMWLSEIEPARIACVLIVVFLLLVVLIPEPEKQRSPQDNQMAIIIMVAVGLLGLITANELGWLERTKSDLSHLMGRREEGATIGFSMDIDLRPASAWAIYAALTTFITPAVQHAVTTSYNNYSLMAMATQAGVLFGMGKGMPFYAWDFGVPLLMIGCYSQLTPLTLIVAIILLVAHYMYLIPGLQAAAARAAQKRTAAGIMKNPVVDGIVVTDIDTMTIDPQVEKKMGQVLLIAVAVSSAILSRTAWGWGEAGALITAATSTLWEGSPNKYWNSSTATSLCNIFRGSYLAGASLIYTVTRNAGLVKRRGGGTGETLGEKWKARLNQMSALEFYSYKKSGITEVCREEARRALKDGVATGGHAVSRGSAKLRWLVERGYLQPYGKVIDLGCGRGGWSYYAATIRKVQEVKGYTKGGPGHEEPVLVQSYGWNIVRLKSGVDVFHMAAEPCDTLLCDIGESSSSPEVEEARTLRVLSMVGDWLEKRPGAFCIKVLCPYTSTMMETLERLQRRYGGGLVRVPLSRNSTHEMYWVSGAKSNIIKSVSTTSQLLLGRMDGPRRPVKYEEDVNLGSGTRAVASCAEAPNMKIIGNRIERIRSEHAETWFFDENHPYRTWAYHGSYEAPTQGSASSLINGVVRLLSKPWDVVTGVTGIAMTDTTPYGQQRVFKEKVDTRVPDPQEGTRQVMSMVSSWLWKELGKHKRPRVCTKEEFINKVRSNAALGAIFEEEKEWKTAVEAVNDPRFWALVDKEREHHLRGECQSCVYNMMGKREKKQGEFGKAKGSRAIWYMWLGARFLEFEALGFLNEDHWMGRENSGGGVEGLGLQRLGYVLEEMSRIPGGRMYADDTAGWDTRISRFDLENEALITNQMEKGHRALALAIIKYTYQNKVVKVLRPAEKGKTVMDIISRQDQRGSGQVVTYALNTFTNLVVQLIRNMEAEEVLEMQDLWLLRRSEKVTNWLQSNGWDRLKRMAVSGDDCVVKPIDDRFAHALRFLNDMGKVRKDTQEWKPSTGWDNWEEVPFCSHHFNKLHLKDGRSIVVPCRHQDELIGRARVSPGAGWSIRETACLAKSYAQMWQLLYFHRRDLRLMANAICSSVPVDWVPTGRTTWSIHGKGEWMTTEDMLVVWNRVWIEENDHMEDKTPVTKWTDIPYLGKREDLWCGSLIGHRPRTTWAENIKNTVNMVRRIIGDEEKYMDYLSTQVRYLGEEGSTPGVL

SEQ ID NO: 89 - protein, 3423 aa, Zika virus
  Strain MRS_OPY_Martinique_PaRi_2015 polyprotein
MKNPKKKSGGFRIVNMLKRGVARVSPFGGLKRLPAGLLLGHGPIRMVLAILAFLRFTAIKPSLGLINRWGSVGKKEAMEIIKKFKKDLAAMLRIINARKEKKRRGAETSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSADVGCSVDFSKKETRCGTGVFVYNDVEAWRDRYKYHPDSPRRLAAAVKQAWEDGICGISSVSRMENIMWRSVEGELNAILEENGVQLTVVVGSVKNPMWRGPQRLPVPVNELPHGWKAWGKSYFVRAAKTNNSFVVDGDTLKECPLKHRAWNSFLVEDHGFGVFHTSVWLKVREDYSLECDPAVIGTAVKGKEAVHSDLGYWIESEKNDTWRLKRAHLIEMKTCEWPKSHTLWTDGIEESDLIIPKSLAGPLSHHNTREGYRTQMKGPWHSEELEIRFEECPGTKVHVEETCGTRGPSLRSTTASGRVIEEWCCRECTMPPLSFWAKDGCWYGMEIRPRKEPESNLVRSMVTAGSTDHMDHFSLGVLVILLMVQEGLKKRMTTKIIISTSMAVLVAMILGGFSMSDLAKLAILMGATFAEMNTGGDVAHLALTAAFKVRPALLVSFIFRANWTPRESMLLALASCLLQTAISALEGDLMVLINGFALAWLAIRAMVVPRTDNITLAILAALTPLARGTLLVAWRAGLATCGGFMLLSLKGKGSVKKNLPFVMALGLTAVRLVDPINVVGLLLLTRSGKRSWPPSEVLTAVGLICALAGGFAKADIEMAGPMAAVGLLIVSYVVSGKSVDMYIERAGDITWEKDAEVTGNSPRLDVALDESGDFSLVEDDGPPMREIILKVVLMTICGMNPIAIPFAAGAWYVYVKTGKRSGALWDVPAPKEVKKGETTDGVYRVMTRRLLGSTQVGVGVMQEGVFHTMWHVTKGSALRSGEGRLDPYWGDVKQDLVSYCGPWKLDAAWDGHSEVQLLAVPPGERARNIQTLPGIFKTKDGDIGAVALDYPAGTSGSPILDKCGRVIGLYGNGVVIKNGSYVSAITQGRREEETPVECFEPSMLKKKQLTVLDLHPGAGKTRRVLPEIVREAIKTRLRTVILAPTRVVAAEMEEALRGLPVRYMTTAVNVTHSGTEIVDLMCHATFTSRLLQPIRVPNYNLYIMDEAHFTDPSSIAARGYISTRVEMGEAAAIFMTATPPGTRDAFPDSNSPIMDTEVEVPERAWSSGFDWVTDHSGKTVWFVPSVRNGNEIAACLTKAGKRVIQLSRKTFETEFQKTKHQEWDFVVTTDISEMGANFKADRVIDSRRCLKPVILDGERVILAGPMPVTHASAAQRRGRIGRNPNKPGDEYLYGGGCAETDEDHAHWLEARMLLDNIYLQDGLIASLYRPEADKVAAIEGEFKLRTEQRKTFVELMKRGDLPVWLAYQVASAGITYTDRRWCFDGTTNNTIMEDSVPAEVWTRHGEKRVLKPRWMDARVCSDHAALKSFKEFAAGKRGAAFGVMEALGTLPGHMTERFQEAIDNLAVLMRAETGSRPYKAAAAQLPETLETIMLLGLLGTVSLGIFFVLMRNKGIGKMGFGMVTLGASAWLMWLSEIEPARIACVLIVVFLLLVVLIPEPEKQRSPQDNQMAIIIMVAVGLLGLITANELGWLERTKSDLSHLMGRREEGATIGFSMDIDLRPASAWAIYAALTTFITPAVQHAVTTSYNNYSLMAMATQAGVLFGMGKGMPFYAWDFGVPLLMIGCYSQLTPLTLIVAIILLVAHYMYLIPGLQAAAARAAQKRTAAGIMKNPVVDGIVVTDIDTMTIDPQVEKKMGQVLLIAVAVSSAILSRTAWGWGEAGALITAATSTLWEGSPNKYWNSSTATSLCNIFRGSYLAGASLIYTVTRNAGLVKRRGGGTGETLGEKWKARLNQMSALEFYSYKKSGITEVCREEARRALKDGVATGGHAVSRGSAKLRWLVERGYLQPYGKVIDLGCGRGGWSYYAATIRKVQEVKGYTKGGPGHEEPVLVQSYGWNIVRLKSGVDVFHMAAEPCDTLLCDIGESSSSPEVEEARTLRVLSMVGDWLEKRPGAFCIKVLCPYTSTMMETLERLQRRYGGGLVRVPLSRNSTHEMYWVSGAKSNTIKSVSTTSQLLLGRMDGPRRPVKYEEDVNLGSGTRAVVSCAEAPNMKIIGNRIERIRSEHAETWFFDENHPYRTWAYHGSYEAPTQGSASSLINGVVRLLSKPWDVVTGVTGIAMTDTTPYGQQRVFKEKVDTRVPDPQEGTRQVMSMVSSWLWKELGKHKRPRVCTKEEFINKVRSNAALGAIFEEEKEWKTAVEAVNDPRFWALVDKEREHHLRGECQSCVYNMMGKREKKQGEFGKAKGSRAIWYMWLGARFLEFEALGFLNEDHWMGRENSGGGVEGLGLQRLGYVLEEMSRIPGGRMYADDTAGWDTRISRFDLENEALITNQMEKGHRALALAIIKYTYQNKVVKVLRPAEKGKTVMDIISRQDQRGSGQVVTYALNTFTNLVVQLIRNMEAEEVLEMQDLWLLRRSEKVTNWLQSNGWDRLKRMAVSGDDCVVKPIDDRFAHALRFLNDMGKVRKDTQEWKPSTGWDNWEEVPFCSHHFNKLHLKDGRSIVVPCRHQDELIGRARVSPGAGWSIRETACLAKSYAQMWQLLYFHRRDLRLMANAICSSVPVDWVPTGRTTWSIHGKGEWMTTEDMLVVWNRVWIEENDHMEDKTPVAKWTDIPYLGKREDLWCGSLIGHRPRTTWAENIKNTVNMVRRIIGDEEKYMDYLSTQVRYLGEEGSTPGVL

SEQ ID NO: 90 - protein, 3423 aa, Zika virus
  Strain H/PF/2013 polyprotein
MKNPKKKSGGFRIVNMLKRGVARVSPFGGLKRLPAGLLLGHGPIRMVLAILAFLRFTAIKPSLGLINRWGSVGKKEAMEIIKKFKKDLAAMLRIINARKEKKRRGADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSADVGCSVDFSKKETRCGTGVFVYNDVEAWRDRYKYHPDSPRRLAAAVKQAWEDGICGISSVSRMENIMWRSVEGELNAILEENGVQLTVVVGSVKNPMWRGPQRLPVPVNELPHGWKAWGKSYFVRAAKTNNSFVVDGDTLKECPLKHRAWNSFLVEDHGFGVFHTSVWLKVREDYSLECDPAVIGTAVKGKEAVHSDLGYWIESEKNDTWRLKRAHLIEMKTCEWPKSHTLWTDGIEESDLIIPKSLAGPLSHHNTREGYRTQMKGPWHSEELEIRFEECPGTKVHVEETCGTRGPSLRSTTASGRVIEEWCCRECTMPPLSFRAKDGCWYGMEIRPRKEPESNLVRSMVTAGSTDHMDHFSLGVLVILLMVQEGLKKRMTTKIIISTSMAVLVAMILGGFSMSDLAKLAILMGATFAEMNTGGDVAHLALIAAFKVRPALLVSFIFRANWTPRESMLLALASCLLQTAISALEGDLMVLINGFALAWLAIRAMVVPRTDNITLAILAALTPLARGTLLVAWRAGLATCGGFMLLSLKGKGSVKKNLPFVMALGLTAVRLVDPINVVGLLLLTRSGKRSWPPSEVLTAVGLICALAGGFAKADIEMAGPMAAVGLLIVSYVVSGKSVDMYIERAGDITWEKDAEVTGNSPRLDVALDESGDFSLVEDDGPPMREIILKVVLMTICGMNPIAIPFAAGAWYVYVKTGKRSGALWDVPAPKEVKKGETTDGVYRVMTRRLLGSTQVGVGVMQEGVFHTMWHVTKGSALRSGEGRLDPYWGDVKQDLVSYCGPWKLDAAWDGHSEVQLLAVPPGERARNIQTLPGIFKTKDGDIGAVALDYPAGTSGSPILDKCGRVIGLYGNGVVIKNGSYVSAITQGRREEETPVECFEPSMLKKKQLTVLDLHPGAGKTRRVLPEIVREAIKTRLRTVILAPTRVVAAEMEEALRGLPVRYMTTAVNVTHSGTEIVDLMCHATFTSRLLQPIRVPNYNLYIMDEAHFTDPSSIAARGYISTRVEMGEAAAIFMTATPPGTRDAFPDSNSPIMDTEVEVPERAWSSGFDWVTDHSGKTVWFVPSVRNGNEIAACLTKAGKRVIQLSRKTFETEFQKTKHQEWDFVVTTDISEMGANFKADRVIDSRRCLKPVILDGERVILAGPMPVTHASAAQRRGRIGRNPNKPGDEYLYGGGCAETDEDHAHWLEARMLLDNIYLQDGLIASLYRPEADKVAAIEGEFKLRTEQRKTFVELMKRGDLPVWLAYQVASAGITYTDRRWCFDGTTNNTIMEDSVPAEVWTRHGEKRVLKPRWMDARVCSDHAALKSFKEFAAGKRGAAFGVMEALGTLPGHMTERFQEAIDNLAVLMRAETGSRPYKAAAAQLPETLETIMLLGLLGTVSLGIFFVLMRNKGIGKMGFGMVTLGASAWLMWLSEIEPARIACVLIVVFLLLVVLIPEPEKQRSPQDNQMAIIIMVAVGLLGLITANELGWLERTKSDLSHLMGRREEGATIGFSMDIDLRPASAWAIYAALTTFITPAVQHAVTTSYNNYSLMAMATQAGVLFGMGKGMPFYAWDFGVPLLMIGCYSQLTPLTLIVAIILLVAHYMYLIPGLQAAAARAAQKRTAAGIMKNPVVDGIVVTDIDTMTIDPQVEKKMGQVLLIAVAVSSAILSRTAWGWGEAGALITAATSTLWEGSPNKYWNSSTATSLCNIFRGSYLAGASLIYTVTRNAGLVKRRGGGTGETLGEKWKARLNQMSALEFYSYKKSGITEVCREEARRALKDGVATGGHAVSRGSAKLRWLVERGYLQPYGKVIDLGCGRGGWSYYAATIRKVQEVKGYTKGGPGHEEPMLVQSYGWNIVRLKSGVDVFHMAAEPCDTLLCDIGESSSSPEVEEARTLRVLSMVGDWLEKRPGAFCIKVLCPYTSTMMETLERLQRRYGGGLVRVPLSRNSTHEMYWVSGAKSNTIKSVSTTSQLLLGRMDGPRRPVKYEEDVNLGSGTRAVVSCAEAPNMKIIGNRIERIRSEHAETWFFDENHPYRTWAYHGSYEAPTQGSASSLINGVVRLLSKPWDVVTGVTGIAMTDTTPYGQQRVFKEKVDTRVPDPQEGTRQVMSMVSSWLWKELGKHKRPRVCTKEEFINKVRSNAALGAIFEEEKEWKTAVEAVNDPRFWALVDKEREHHLRGECQSCVYNMMGKREKKQGEFGKAKGSRAIWYMWLGARFLEFEALGFLNEDHWMGRENSGGGVEGLGLQRLGYVLEEMSRIPGGRMYADDTAGWDTRISRFDLENEALITNQMEKGHRALALAIIKYTYQNKVVKVLRPAEKGKTVMDIISRQDQRGSGQVVTYALNTFTNLVVQLIRNMEAEEVLEMQDLWLLRRSEKVTNWLQSNGWDRLKRMAVSGDDCVVKPIDDRFAHALRFLNDMGKVRKDTQEWKPSTGWDNWEEVPFCSHHFNKLHLKDGRSIVVPCRHQDELIGRARVSPGAGWSIRETACLAKSYAQMWQLLYFHRRDLRLMANAICSSVPVDWVPTGRTTWSIHGKGEWMTTEDMLVVWNRVWIEENDHMEDKTPVTKWTDIPYLGKREDLWCGSLIGHRPRTTWAENIKNTVNMVRRIIGDEEKYMDYLSTQVRYLGEEGSTPGVL

SEQ ID NO: 91 - protein, 3423 aa, Zika virus
  Strain MR 766 polyprotein
MKNPKKKSGGFRIVNMLKRGVARVNPLGGLKRLPAGLLLGHGPIRMVLAILAFLRFTAIKPSLGLINRWGSVGKKEAMEIIKKFKKDLAAMLRIINARKERKRRGADTSIGIIGLLLTTAMAAEITRRGSAYYMYLDRSDAGKAISFATTLGVNKCHVQIMDLGHMCDATMSYECPMLDEGVEPDDVDCWCNTTSTWVVYGTCHHKKGEARRSRRAVTLPSHSTRKLQTRSQTWLESREYTKHLIKVENWIFRNPGFALVAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIVNDTGYETDENRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGKLFSGHLKCRLKMDKLRLKGVSYSLCTAAFTFTKVPAETLHGTVTVEVQYAGTDGPCKIPVQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSADVGCSVDFSKKETRCGTGVFIYNDVEAWRDRYKYHPDSPRRLAAAVKQAWEEGICGISSVSRMENIMWKSVEGELNAILEENGVQLTVVVGSVKNPMWRGPQRLPVPVNELPHGWKAWGKSYFVRAAKTNNSFVVDGDTLKECPLEHRAWNSFLVEDHGFGVFHTSVWLKVREDYSLECDPAVIGTAVKGREAAHSDLGYWIESEKNDTWRLKRAHLIEMKTCEWPKSHTLWTDGVEESDLIIPKSLAGPLSHHNTREGYRTQVKGPWHSEELEIRFEECPGTKVYVEETCGTRGPSLRSTTASGRVIEEWCCRECTMPPLSFRAKDGCWYGMEIRPRKEPESNLVRSMVTAGSTDHMDHFSLGVLVILLMVQEGLKKRMTTKIIMSTSMAVLVVMILGGFSMSDLAKLVILMGATFAEMNTGGDVAHLALVAAFKVRPALLVSFIFRANWTPRESMLLALASCLLQTAISALEGDLMVLINGFALAWLAIRAMAVPRTDNIALPILAALTPLARGTLLVAWRAGLATCGGIMLLSLKGKGSVKKNLPFVMALGLTAVRVVDPINVVGLLLLTRSGKRSWPPSEVLTAVGLICALAGGFAKADIEMAGPMAAVGLLIVSYVVSGKSVDMYIERAGDITWEKDAEVTGNSPRLDVALDESGDFSLVEEDGPPMREIILKVVLMAICGMNPIAIPFAAGAWYVYVKTGKRSGALWDVPAPKEVKKGETTDGVYRVMTRRLLGSTQVGVGVMQEGVFHTMWHVTKGAALRSGEGRLDPYWGDVKQDLVSYCGPWKLDAAWDGLSEVQLLAVPPGERARNIQTLPGIFKTKDGDIGAVALDYPAGTSGSPILDKCGRVIGLYGNGVVIKNGSYVSAITQGKREEETPVECFEPSMLKKKQLTVLDLHPGAGKTRRVLPEIVREAIKKRLRTVILAPTRVVAAEMEEALRGLPVRYMTTAVNVTHSGTEIVDLMCHATFTSRLLQPIRVPNYNLYIMDEAHFTDPSSIAARGYISTRVEMGEAAAIFMTATPPGTRDAFPDSNSPIMDTEVEVPERAWSSGFDWVTDHSGKTVWFVPSVRNGNEIAACLTKAGKRVIQLSRKTFETEFQKTKNQEWDFVITTDISEMGANFKADRVIDSRRCLKPVILDGERVILAGPMPVTHASAAQRRGRIGRNPNKPGDEYMYGGGCAETDEGHAHWLEARMLLDNIYLQDGLIASLYRPEADKVAAIEGEFKLRTEQRKTFVELMKRGDLPVWLAYQVASAGITYTDRRWCFDGTTNNTIMEDSVPAEVWTKYGEKRVLKPRWMDARVCSDHAALKSFKEFAAGKRGAALGVMEALGTLPGHMTERFQEAIDNLAVLMRAETGSRPYKAAAAQLPETLETIMLLGLLGTVSLGIFFVLMRNKGIGKMGFGMVTLGASAWLMWLSEIEPARIACVLIVVFLLLVVLIPEPEKQRSPQDNQMAIIIMVAVGLLGLITANELGWLERTKNDIAHLMGRREEGATMGFSMDIDLRPASAWAIYAALTTLITPAVQHAVTTSYNNYSLMAMATQAGVLFGMGKGMPFYAWDLGVPLLMMGCYSQLTPLTLIVAIILLVAHYMYLIPGLQAAAARAAQKRTAAGIMKNPVVDGIVVTDIDTMTIDPQVEKKMGQVLLIAVAISSAVLLRTAWGWGEAGALITAATSTLWEGSPNKYWNSSTATSLCNIFRGSYLAGASLIYTVTRNAGLVKRRGGGTGETLGEKWKARLNQMSALEFYSYKKSGITEVCREEARRALKDGVATGGHAVSRGSAKLRWLVERGYLQPYGKVVDLGCGRGGWSYYAATIRKVQEVRGYTKGGPGHEEPMLVQSYGWNIVRLKSGVDVFHMAAEPCDTLLCDIGESSSSPEVEETRTLRVLSMVGDWLEKRPGAFCIKVLCPYTSTMMETMERLQRRHGGGLVRVPLSRNSTHEMYWVSGAKSNIIKSVSTTSQLLLGRMDGPRRPVKYEEDVNLGSGTRAVASCAEAPNMKIIGRRIERIRNEHAETWFLDENHPYRTWAYHGSYEAPTQGSASSLVNGVVRLLSKPWDVVTGVTGIAMTDTTPYGQQRVFKEKVDTRVPDPQEGTRQVMNIVSSWLWKELGKRKRPRVCTKEEFINKVRSNAALGAIFEEEKEWKTAVEAVNDPRFWALVDREREHHLRGECHSCVYNMMGKREKKQGEFGKAKGSRAIWYMWLGARFLEFEALGFLNEDHWMGRENSGGGVEGLGLQRLGYILEEMNRAPGGKMYADDTAGWDTRISKFDLENEALITNQMEEGHRTLALAVIKYTYQNKVVKVLRPAEGGKTVMDIISRQDQRGSGQVVTYALNTFTNLVVQLIRNMEAEEVLEMQDLWLLRKPEKVTRWLQSNGWDRLKRMAVSGDDCVVKPIDDRFAHALRFLNDMGKVRKDTQEWKPSTGWSNWEEVPFCSHHFNKLYLKDGRSIVVPCRHQDELIGRARVSPGAGWSIRETACLAKSYAQMWQLLYFHRRDLRLMANAICSAVPVDWVPTGRTTWSIHGKGEWMTTEDMLMVWNRVWIEENDHMEDKTPVTKWTDIPYLGKREDLWCGSLIGHRPRTTWAENIKDTVNMVRRIIGDEEKYMDYLSTQVRYLGEEGSTPGVL

SEQ ID NO: 92 - protein, 3423 aa, Zika virus
  Strain 8375 polyprotein
MKNPKKKSGGFRIVNMLKRGVARVSPFGGLKRLPAGLLLGHGPIRMVLAILAFLRFTAIKPSLGLINRWGSVGKKEAMEIIKKFKKDLAAMLRIINARKEKKRRGADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEIRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSADVGCSVDFSKKETRCGTGVFVYNDVEAWRDRYKYHPDSPRRLAAAVKQAWEDGICGISSVSRMENIMWRSVEGELNAILEENGVQLTVVVGSVKNPMWRAPQRLPVPVNELPHGWKAWGKSYFVRAAKTNNSFVVDGDTLKECPLKHRAWNSFLVEDHGFGVFHTSVWLKVREDYSLECDPAVIGTAVKGKEAVHSDLGYWIESEKNDTWRLKRAHLIEMKTCEWPKSHTLWTDGIEESDLIIPKSLAGPLSHHNTREGYRTQMKGPWHSEELEIRFEECPGTKVHVEETCGTRGPSLRSTTASGRVIEEWCCRECTMPPLSFRAKDGCWYGMEIRPRKEPESNLVRSMVTAGSTDHMDHFSLGVLVILLMVQEGLKKRMTTKIIISTSMAVLVAMILGGFSMSDLAKLAILMGATFAEMNTGGDVAHLALIAAFKVRPALLVSFIFRANWTPRESMLLALASCLLQTAISALEGDLMVLINGFALAWLAIRAMVVPRTDNITLAILAALTPLARGTLLVAWRAGLATCGGFMLLSLKGKGSVKKNLPFVMALGLTAVRLVDPINVVGLLLLTRSGKRSWPPSEVLTAVGLICALAGGFAKADIEMAGPMAAVGLLIVSYVVSGKSVDMYIERAGDITWEKDAEVTGNSPRLDVALDESGDFSLVEDDGPPMREIILKVVLMTICGMNPIAIPFAAGAWYVYVKTGKRSGALWDVPAPKEVKKGETTDGVYRVMTRRLLGSTQVGVGVMQEGVFHTMWHVTKGSALRSGEGRLDPYWGDVKQDLVSYCGPWKLDAAWDGHSEVQLLAVPPGERARNIQTLPGIFKTKDGDIGAVALDYPAGTSGSPILDKCGRVIGLYGNGVVIKNGSYVSAITQGRREEETPVECFEPSMLKKKQLTVLDLHPGAGKTRRVLPEIVREAIKTRLRTVILAPTRVVAAEMEEALRGLPVRYMTTAVNVTHSGTEIVDLMCHATFTSRLLQPIRVPNYNLYIMDEAHFTDPSSIAARGYISTRVEMGEAAAIFMTATPPGTRDAFPDSNSPIMDTEVEVPERAWSSGFDWVTDHSGKTVWFVPSVRNGNEIAACLTKAGKRVIQLSRKTFETEFQKTKHQEWDFVVTTDISEMGANFKADRVIDSRRCLKPVILDGERVILAGPMPVTHASAAQRRGRIGRNPNKPGDEYLYGGGCAETDEDHAHWLEARMLLDNIYLQDGLIASLYRPEADKVAAIEGEFKLRTEQRKTFVELMKRGDLPVWLAYQVASAGITYTDRRWCFDGTTNNTILEDSVPAEVWTRHGEKRVLKPRWMDARVCSDHAALKSFKEFAAGKRGAAFGVMEALGTLPGHMTERFQEAIDNLAVLMRAETGSRPYKAAAAQLPETLETIMLLGLLGTVSLGIFFVLMRNKGIGKMGFGMVTLGASAWLMWLSEIEPARIACVLIVVFLLLVVLIPEPEKQRSPQDNQMAIIIMVAVGLLGLITANELGWLERTKSDLSHLMGRREEGATIGFSMDIDLRPASAWAIYAALTTFITPAVQHAVTTSYNNYSLMAMATQAGVLFGMGKGMPFYAWDFGVPLLMIGCYSQLTPLTLIVAIILLVAHYMYLIPGLQAAAARAAQKRTAAGIMKNPVVDGIVVTDIDTMTIDPQVEKKMGQVLLIAVAVSSAILSRTAWGWGEAGALITAATSTLWEGSPNKYWNSSTATSLCNIFRGSYLAGASLIYTVTRNAGLVKRRGGGTGETLGEKWKARLNQMSALEFYSYKKSGITEVCREEARRALKDGVATGGHAVSRGSAKLRWLVERGYLQPYGKVIDLGCGRGGWSYYAATIRKVQEVKGYTKGGPGHEEPVLVQSYGWNIVRLKSGVDVFHMAAEPCDTLLCDIGESSSSPEVEEARTLRVLSMVGDWLERRPGAFCIKVLCPYTSTMMETLERLQRRYGGGLVRVPLSRNSTHEMYWVSGAKSNTIKSVSTTSQLLLGRMDGPRRPVKYEEDVNLGSGTRAVVSCAEAPNMKIIGNRIERIRSEHAETWFFDENHPYRTWAYHGSYEAPTQGSASSLINGVVRLLSKPWDVVTGVTGIAMTDTTPYGQQRVFKEKVDTRVPDPQEGTRQVMSMVSSWLWKELGKHKRPRVCTKEEFINKVRSNAALGAIFEEEKEWKTAVEAVNDPRFWALVDKEREHHLRGECQSCVYNMMGKREKKQGEFGKAKGSRAIWYMWLGARFLEFEALGFLNEDHWMGRENSGGGVEGLGLQRLGYVLEEMSCIPGGRMYADDTAGWDTRISRFDLENEALITNQMEKGHRALALAIIKYTYQNKVVKVLRPAEKGKTVMDIISRQDQRGSGQVVTYALNTFTNLVVQLIRNMEAEEVLEMQDLWLLRRSEKVTNWLQSNGWDRLKRMAVSGDDCVVKPIDDRFAHALRFLNDMGKVRKDTQEWKPSTGWDNWEEVPFCSHHFNKLHLKDGRSIVVPCRHQDELIGRARVSPGAGWSIRETACLAKSYAQMWQLLYFHRRDLRLMANAICSSVPVDWVPTGRTTWSIHGKGEWMTTEDMLVVWNRVWIEENDHMEDKTPVTKWTDIPYLGKREDLWCGSLIGHRPRTTWAENIKNTVNMVRRIIGDEEKYMDYLSTQVRYLGEEGSTPGVL

SEQ ID NO: 93 - protein, 3423 aa, Zika virus; identical to SEQ ID NO: 92
  Strain 103344 polyprotein

SEQ ID NO: 94 - protein, 3423 aa, Zika virus
  Strain ArD158084 polyprotein
MKNPKKKSGGFRIVNMLKRGVARVNPLGGLKRLPAGLLLGHGPIRMVLAILAFLRFTAIKPSLGLINRWGSVGKKEAMEIIKKFKKDLAAMLRIINARKERKRRGADTSIGIIGLLLTTAMAAEITRRGSAYYMYLDRSDAGKAISFATTLGVNKCHVQIMDLGHMCDATMSYECPMLDEGVEPDDVDCWCNTTSTWVVYGTCHHKKGEARRSRRAVTLPSHSTRKLQTRSQTWLESREYTKHLIKVENWIFRNPGFALVAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIVNDIGHETDENRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQYAGTDGPCKVPAQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSADVGCSVDFSKRETRCGTGVFIYNDVEAWRDRYKYHPDSPRRLAAAVKQAWEEGICGISSVSRMENIMWKSVEGELNAILEENGVQLTVVVGSVKNPMWRGPQRLPVPVNGLPHGWKAWGKSYFVRAAKTNNSFVVDGDTLKECPLKHRAWNSFLVEDHGFGVFHTSVWLKVREDYSLECDPAVIGTAVKGREAAHSDLGYWIESEKNDTWRLKRAHLIEMKTCEWPKSHTLWTDGVEESDLIIPKSLAGPLSHHNTREGYRTQVKGPWHSEELEIRFEECPGTKVHVEETCGTRGPSLRSTTASGRVIEEWCCRECTMPPLSFRAKDGCWYGMEIRPRKEPESNLVRSMVTAGSTDHMDHFSLGVLVILLMVQEGLKKRMTTKIIMSTSMAVLVVMILGGFSMSDLAKLVILMGATFAEMNTGGDVAHLALVAAFKVRPALLVSFILRANWTPRESMLLALASCLLQTAISALEGDLMVLVNGFALAWLAIRAMAVPRTDNIALAILAALTPLARGTLLVAWRAGLATCGGFMLLSLKGKGSVKKNLPFVMALGLTAVRVVDPINVVGLLLLTRSGKRSWPPSEVLTAVGLICALAGGFAKADIEMAGPMAAVGLLIVSYVVSGKSVDMYIERAGDITWEKDAEVTGNSPRLDVALDESGDFSLVEEDGPPMREIILKVVLMAICGMNPIAIPFAAGAWYVYVKTGKRSGALWDVPAPKEVKKGETTDGVYRVMTRRLLGSTQVGVGVMQEGVFHTMWHVTKGAALRSGEGRLDPYWGDVKQDLVSYCGPWKLDAAWDGLSEVQLLAVPPGERARNIQTLPGIFKTKDGDIGAVALDYPAGTSGSPILDKCGRVIGLYGNGVVIKNGSYVSAITQGKREEETPVECFEPSMLKKKQLTVLDLHPGAGKTRRVLPEIVREAIKKRLRTVILAPTRVVAAEMEEALRGLPVRYMTTAVNVTHSGTEIVDLMCHATFTSRLLQPIRVPNYNLNIMDEAHFTDPSSIAARGYISTRVEMGEAAAIFMTATPPGTRDAFPDSNSPIMDTEVEVPERAWSSGFDWVTDHSGKTVWFVPSVRNGNEIAACLTKAGKRVIQLSRKTFETEFQKTKNQEWDFVITTDISEMGANFKADRVIDSRRCLKPVILDGERVILAGPMPVTHASAAQRRGRIGRNPNKPGDEYMYGGGCAETDEGHAHWLEARMLLDNIYLQDGLIASLYRPEADKVAAIEGEFKLRTEQRKTFVELMKRGDLPVWLAYQVASAGITYTDRRWCFDGTTNNTIMEDSVPAEVWTKYGEKRVLKPRWMDARVCSDHAALKSFKEFAAGKRGAALGVMEALGTLPGHMTERFQEAIDNLAVLMRAETGSRPYKAAAAQLPETLETIMLLGLLGTVSLGIFFVLMRNKGIGKMGFGMVTLGASAWLMWLSEIEPARIACVLIVVFLLLVVLIPEPEKQRSPQDNQMAIIIMVAVGLLGLITANELGWLERTKNDIAHLMGRREEGATMGFSMDIDLRPASAWAIYAALTTLITPAVQHAVTTSYNNYSLMAMATQAGVLFGMGKGMPFYAWDFGVPLLMMGCYSQLTPLTLIVAIILLVAHYMYLIPGLQAAAARAAQKRTAAGIMKNPVVDGIVVTDIDTMTIDPQVEKKMGQVLLIAVAISSAVLLRTAWGWGEAGALITAATSTLWEGSPNKYWNSSTATSLCNIFRGSYLAGASLIYTVTRNAGLVKRRGGGTGETLGEKWKARLNQMSALEFYSYKKSGITEVCREEARRALKDGVATGGHAVSRGSAKLRWLVERGYLQPHGKVVDLGCGRGGWSYYAATIRKVQEVRGYTKGGPGHEEPMLVQSYGWNIVRLKSGVDVFHMAAEPCDTLLCDIGESSSSPEVEETRTLRVLSMVGDWLEKRPGAFCIKVLCPYTSTMMETMERLQRRHGGGLVRVPLSRNSTHEMYWVSGAKSNIIKSVSTTSQLLLGRMDGPRRPVKYEEDVNLGSGTRAVASCAEAPNMKIIGRRIERIRNEHAETWFLDENHPYRTWAYHGSYEAPTQGSASSLVNGVVRLLSKPWDVVTGVTGIAMTDTTPYGQQRVFKEKVDTRVPDPQEGTRQVMNMVSSWLWKELGKRKRPRVCTKEEFINKVRSNAALGAIFEEEKEWKTAVEAVNDPRFWALVDREREHHLRGECHSCVYNMMGKREKKQGEFGKAKGSRAIWYMWLGARFLEFEALGFLNEDHWMGRENSGGGVEGLGLQRLGYVLEEMSQAPGGKMYADDTAGWDTRISKFDLENEALITNQMEEGHRTLALAVIKYTYQNKVVKVLRPAEGGKTVMDIISRQDQRGSGQVVTYALNTFTNLVVQLIRNMEAEEVLEMQDLWLLRKPEKVTRWLQSNGWDGLKRMAVSGDDCVVKPIDDRFAHALRFLNDMGKVRKDTQEWKPSTGWSNWEEVPFCSHHFNKLYLKDGRSIVVPCRHQDELIGRARVSPGAGWSIRETACLAKSYAQMWQLLYFHRRDLRLMANAICSAVPVDWVPTGRTTWSIHGKGEWMTTEDMLMVWNRVWIEENDHMEDKTPVTKWTDIPYLGKREDLWCGSLIGHRPRTTWAENIKDTVNMVRRIIGDEEKYMDYLSTQVRYLGEEGSTPGVL

SEQ ID NO: 95 - protein, 3423 aa, Zika virus
  Strain ArD157995 polyprotein
  misc_feature (904)..(904): Xaa can be any naturally occurring amino acid
  misc_feature (2829)..(2829): Xaa can be any naturally occurring amino acid
MKNPKKKSGRFRIVNMLKRGVARVNPLGGLKRLPAGLLLGHGPIRMVLAILAFLRFTAIKPSLGLINRWGSVGKKEAMEIIKKFKKDLAAMLRIINARKERKRRGADTSIGIIGLLLTTAMAAEITRRGSAYYMYLDRSDAGKAISFATTLGVNKCHVQIMDLGHMCDATMSYECPMLDEGVEPDDVDCWCNTTSTWVVYGTCHHKKGETRRSRRSVSLRYHYTRKLQTRSQTWLESREYKKHLIMVENWIFRNPGFAIVSVAITWLMGSLTSQKVIYLVMIVLIVPAYSISCIGVSNRDLVEGMSGGTWVDVVLEHGGCVTEMAQDKPTVDIELVTMTVSNMAEVRSYCYEASLSDMASASRCPTQGEPSLDKQSDTQSVCKRTLGDRGWGNGCGIFGKGSLVTCSKFTCCKKMPGKSIQPENLEYRIMLPVHGSQHSGMIVNDIGHETDENRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQSAGTDGPCKVPAQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSADVGCSVDFSKKETRCGTGVFIYNDVEAWRDRYKYHPDSPRRLAAAVKQAWEEGICGISSVSRMENIMWKSVEGELNAILEENGVQLTVVVGSVKNPMWRGPQRLPVPVNXLPHGWKAWGKSYFVRAAKTNNSFVVDGDTLKECPLKHRAWNSFLVEDHGFGVFHTSVWLKVREDYSLECDPAVIGTAVKGREAAHSDLGYWIESEKNDTWRLKRAHLIEMKTCEWPKSHTLWTDGVEESDLIIPKSLAGPLSHHNTREGYRTQVKGPWHSEELEIRFEECPGTKVHVEETCGTRGPSLRSTTASGRVIEEWCCRECTMPPLSFRAKDGCWYGMEIRPRKEPESNLVRSMVTAGSTDHMDHFSLGVLVILLMVQEGLKKRMTTKIIMSTSMAVLVVMILGGFSMSDLAKLVILMGATFAEMNTGGDVAHLALVAAFKVRPALLVSFILRANWTPRESMLLALASCLLQTAISALEGDLMVLVNGFALAWLAIRAMAVPRTDNIALAILAALTPLARGTLLVAWRAGLATCGGFMLLSLKGKGSVKKNLPFVMALGLTAVRVVDPINVVGLLLLTRSGKRSWPPSEVLTAVGLICALAGGFAKADIEMAGPMAAVGLLIVSYVVSGKSVDMYIERAGDITWEKDAEVTGNSPRLDVALDESGDFSLVEEDGPPMREIILKVVLMAICGMNPIAIPFAAGAWYVYVKTGKRSGALWDVPAPKEVKKGETTDGVYRVMTRRLLGSTQVGVGVMQEGVFHTMWHVTKGAALRSGEGRLDPYWGDVKQDLVSYCGPWKLDAAWDGLSEVQLLAVPPGERARNIQTLPGIFKTKDGDIGAVALDYPAGTSGSPILDKCGRVIGLYGNGVVIKNGSYVSAITQGKREEETPVECFEPSMLKKKQLTVLDLHPGAGKTRRVLPEIVREAIKKRLRTVILAPTPVERSYSRWSLWPSVARTQTTAVNVTHSGTEIVDLMCHATFTSRLLQPIRVPNYNLNIMDEAHFTDPSSIAARGYISTRVEMGEAAAIFMTATPPGTRDAFPDSNSPIMDTEVEVPERAWSSGFDWVTDHSGKTVWFVPSVRSGEESAACLTKAGKRVIQLSRKTFETEFQKTKNQEWDFVITTDISEMGANFKADRVIDSRRCLKPVILDGERVILAGPMPVTHASAAQRRGRIGRNPNKPGDEYMYGGGCAETDEDHAHWLEARMLLDNIYLQDGLIASLYRPEADKVAAIEGEFKLRTEQRKTFVELMKRGDLPVWLAYQVASAGITYTDRRWCFDGTTNNTIMEDSVPAEVWTKYGEKRVLKPRWMDARVCSDHAALKSFKEFAAGKRGAALGVMEALGTLPGHMTERFQEAIDNLAVLMRAETGSRPYKAAAAQLPETLETIMLLGLLGTVSLGIFFVLMRNKGIGKMGFGMVTLGASAWLMWLSEIEPARIACVLIVVFLLLVVLIPEPEKQRSPQDNQMAIIIMVAVGLLGLITANELGWLERTKNDIAHLMGRREEGATMGFSMDIDLRPASAWAIYAALTTLITPAVQHAVTTSYNNYSLMAMATQAGVLFGMGKGMPFMHGDLGVPLLMMGCYSQLTPLTLIVAIILLVAHYMYLIPGLQAAAARAAQKRTAAGIMKNPVVDGIVVTDIDTMTIDPQVEKKMGQVLLIAVAISSAVLLRTAWGWGEAGALITAATSTLWEGSPNKYWNSSTATSLCNIFRGSYLAGASLIYTVTRNAGLVKRRGGGTGETLGEKWKARLNQMSALEFYSYKKSGITEVCREEARRALKDGVATGGHAVSRGSAKLRWLVERGYLQPHGKVVDLGCGRGGWSYYAATIRKVQEVRGYTKGGPGHEEPMLVQSYGWNIVRLKSGVDVFHMAAEPCDTLLCDIGESSSSPEVEETRTLRVLSMVGDWLEKRPGAFCIKVLCPYTSTMMETMERLQRRHGGGLVRVPLSRNSTHEMYWVSGAKSNIIKSVSTTSQLLLGRMDGPRRPVKYEEDVNLGSGTRAVASCAEAPNMKIIGRRIERIRNEHAETWFLDENHPYRTWAYHGXYEAPTQGSASSLVNGVVRLLSKPWDVVTGVTGIAMTDTTPYGQQRVFKEKVDTRVPDPQEGTRQVMNMVSSWLWKELGKRKRPRVCTKEEFINKVRSNAALGAIFEEEKEWKTAVEAVNDPRFWALVDREREHHLRGECHSCVYNMMGKREKKQGEFGKAKGSRAIWYMWLGARFLEFESLGFLNEDHWMGRENSGGGVEGLGLQRLGYVLEEMSQAPGGKMYADDTAGWDTRISKFDLENEALITNQMEEGHRTLALAVIKYTYQNKVVKVLRPAEGGKTVMDIISRQDQRGSGQVVTYALNTFTNLVVQLIRNMEAEEVLEMQDLWLLRKPEKVTRWLQSNGWDRLKRMAVSGDDCVVKPIDDRFAHALRFLNDMGKVRKDTQEWKPSTGWSNWEEVPFCSHHFNKLYLKDGRSIVVPCRHQDELIGRARVSPGAGWSIRETACLAKSYAQMWQLLYFHRRDLRLMANAICSAVPVDWVPTGRTTWSIHGKGEWMTTEDMLMVWNRVWIEENDHMEDKTPVTKWTDIPYLGKREDLWCGSLIGHRPRTTWAENIKDTVNMVRRIIGDEEKYMDYLSTQVRYLGEEGSTPGVL

SEQ ID NO: 96 - protein, 3423 aa, Zika virus
  Strain ArD128000 polyprotein
  misc_feature (442)..(446): Xaa can be any naturally occurring amino acid
MKNPKRKSGGFRIVNMLKRGVARVNPLGGLKRLPAGLLLGHGPIRMVLAILAFLRFTAIKPSLGLINRWGSVGKKEAMEIIKKFKKDLAAMLRIINARKERKRRGADTSIGIIGLLLTTAMAAEITRRGSAYYMYLDRSDAGKAISFATTLGVNKCHVQIMDLGHMCDATMSYECPMLDEGVEPDDVDCWCNTTSTWVVYGTCHHKKGEARRSRRAVTLPSHSTRKLQTRSQTWLESREYTKHLIKVENWIFRNPGFALAAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMXXXXXGHETDENRAKVEVTPNSPRAEATLGGFGSLGLDCEPRTGLDFSDLYYLTMNNKHRLVRKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQYAGTDGPCKVPAQMAVDMQTLTPVGRLITANPVITESTENSKMMLELDPPFGDSYIVIGVGDKKITHHWLKKGSSIGKAFEATVRGAKRMAVLGDTAWDFGSVGGVFNSLGKGVHQIFGAAFKSLFGGMSWFSQILIGTLLVWLGLNTKNGSISLTCLALGGVMIFLSTAVSADVGCSVDFSKKETRCGTGVFVYNDVEAWRDRYKYHPDSPRRLAAAVKQAWEEGICGISSVSRMENIMWKSVEGELNAILEENGVQLTVVVGSVKNPMWRGPQRLPVPVNELPHGWKAWGKSYFVRAAKTNNSFVVDGDTLKECPLKHRAWNSFLVEDHGFGIFHTSVWLKVREDYSLECDPAVIGTAVKGKEAAHSDLCYWIESEKNDTWRLRRAHLIEMKTCEWPKSHTLWTDGVEESDLIIPKSLAGPLSHHNTREGYRTQVKGPWHSEELEIRFEECPGTKVYVEETCGTRGPSLRSTTASGRVIEEWCCRECTMPPLSFRAKDGCWYGMEIRPRKEPESNLVRSMVTAGSTDHMDHFSLGVLVILLMVQEGLKKRMTTKIIMSTSMAVLVAMVLGGFSMSDLAKLVILMGATFAEMNTGGDVAHLALVAAFKVRPALLVSFIFRANWTPRESMLLALASCLLQTAISALEGELMVLVNGFALAWLAIRAMAVPRTDNIALATLAALTPLARGTLLVAWRAGLATCGGFMLLSLKGKGSVKKNLPFVMALGLAAVRIVDPINVVGLLLLTRSGKRSWPPSEVLTAVGLICALAGGFAKADIEMAGPMAAVGLLIVSYVVSGKSVDMYIERAGDITWEKDAEVTGNSPRLDVALDESGDFSLVEEDGPPMREIILKVVLMAICGMNPIAIPFAAGAWYVYVKTGKRSGALWDVPAPKEVKKGETTDGVYRVMTRRLLGSTQVGVGVMQEGVFHTMWHVTKGAALRSGEGRLDPYWGDVKQDLVSYCGPWKLDATWDGLSEVQLLAVPPGERARNIQTLPGIFKTKDGDIGAVALDYPAGTSGSPILDKCGRVIGLYGNGVVIKNGSYVSAITQGKREEEAPVECFEPSMLRKKQLTVLDLHPGAGKTRRVLPEIVREAIKKRLRTVILAPTRVVAAEMEEALRGLPVRYMTTAVNVTHSGTEIVDLMCHATFTSRLLQPIRVPNYNLNIMDEAHFTDPSSIAARGYISTRVEMGEAAAIFMTATPPGTRDAFPDSNSPIMDTEVEVPERAWSSGFDWVTDHSGKTIWFVPSVRNGNEIAACLTKAGKRVIQLSRKTFETEFQKTKNQEWDFVITTDISEMGANFKADRVIDSRRCLKPVILDGERVILAGPMPVTHASAAQRRGRIGRNPNKPGDEYMYGGGCAETDEDHAHWLEARMLLDNIYLQDGLIASLYRPEADKVAAIEGEFKLRTEQRKTFVELMKRGDLPVWLAYQVASAGITYTDRRWCFDGTTNNTIMEDSVPAEVWTKYGEKRVLKPRWMDARVCSDHAALKSFKEFAAGKRGAALGVMDALGTLPGHMTERFQEAIDNLAVLMRAETGSRPYKAAAAQLPETLETIMLLGLLGTVSLGIFFVLMRNKGIGKMGFGMVTLGASAWLMWLSEIEPARIACVLIVVFLLLVVLIPEPEKQRSPQDNQMAIIIMVAVGLLGLITANELGWLERTKSDIAYLMGRKEEGTTIGFSMDIDLRPASAWAIYAALTTLITPAVQHAVTTSYNNYSLMAMATQAGVLFGMGKGMPFYAWDFGVPLLMIGCYSQLTPLTLIVAIILLVAHYMYLIPGLQAAAARAAQKRTAAGIMKNPVVDGIVVTDIDTMTIDPQVEKKMGQVLLIAVAVSSAVLLRTAGGWGEAGALITAATSTLWEGSPNKYWNSSTATSLCNIFRGSYLAGASLIYTVTRNAGLVKRRGGGTGETLGEKWKARLNQMSALEFYSYKKSGITEVCREEARRALKDGVATGGHAVSRGSAKLRWLVERGYLQPHGKVVDLGCGRGGWSYYAATIRKVQEVRGYTKGGPGHEEPMLVQSYGWNIVRLKSGVDVFHMAAEPCDTLLCDIGESSSSPEVEETRTLRVLSMVEDWLEKRPGAFCIKVLCPYTSTMMETMERLQRRHGGGLVRVPLSRNSTHEMYWVSGAKSNIIKSVSTTSQLLLGRMDGPRRPVKYEEDVNLGSGTRAVASCAEAPNMKIIGRRIERIRNEHAETWFFDENHPYRTWAYHGSYEAPTQGSASSLVNGVVRLLSKPWDVVTGVTGIAMTDTTPYGQQRVFKEKVDTRVPDPQEGTRQVMNIVSSWLWKELGKRKRPRVCTKEEFINKVRSNAALGAIFEEEKEWKTAVEAVNDPRFWALVDKEREHHLRGECHSCVYNMMGKREKKQGEFGKAKGSRAIWYMWLGARFLEFEALGFLNEDHWMGRENSGGGVEGLGLQRLGYILEEMNRAPGGKMYADDTAGWDTRISKFDLENEALITNQMEEGHRALALAVIKYTYQNKVVKVLRPAEGGKTVMDIISRQDQRGSGQVVTYALNTFTNLVVQLIRNMEAEEVLEMHDLWLLRKPEKVTRWLQSNGWDRLKRMAVSGDDCVVKPIDDRFAHALRFLNDMGKVRKDTQEWKPSTGWSNWEEVPFCSHHFNKLHLKDGRSIVVPCRHQDELIGRARVSPGAGWSIRETACLAKSYAQMWQLLYFHRRDLRLMANAICSAVPVDWVPTGRTTWSIHGKGEWMTTEDMLMVWNRVWIEENDHMEDKTPVPKWTEIPYLGKRESLWCGYIIGHRPRTTWAENIKDTVNMVLRLIGDEEKYMDYLSTQVRYLGEEGSTPGVL

SEQ ID NO: 97 - protein, 3423 aa, Zika virus
  Strain ArD7117 polyprotein
  misc_feature (1437)..(1437): Xaa can be any naturally occurring amino acid
  misc_feature (1742)..(1742): Xaa can be any naturally occurring amino acid
MKNPKKRSGGFRIVNMLKRGVARVNPLGGLKRLPAGLLLGHGPIRMVLAILAFLRFTAIKPSLGLINRWGSVGKKEAMEIIKKFKKDLAAMLRIINARKERKRRGADTSIGIVGLLLTTAMAAEITRRGSAYYMYLDRSDAGKAISFATTLGVNKCHVQIMDLGHMCDATMSYECPMLDEGVEPDDVDCWCNTTSTWVVYGTCQHKKGEARRSRRAVTLPSHSTRKLQTRSQTWLESREYTKHLIKVENWIFRNPGFALVAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIVNDIGHETDENRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAVCTAAKVPAETLHGTVTVEVQYAGTDGPCKVPAQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSADVGCSVDFSKKETRCGTGVFVYNDVEAWRDRYKYHPDSPRRLAAAVKQAWEEGICGISSVSRMENIMWKSVEGELNAILEENGVQLTVVVGSVKNPMWRGPQRLPVPVNELPHGWKAWGKSYFVRAAKTNNSFVVDGDTLKECPLKHRAWNSFLVEDHGFGIFHTSVWLKVREDYSLECDPAVIGTAVKGKEAAHSDLGYWIESEKNDTWRLRRAHLIEMKTCEWPKSHTLWTDGVEESDLIIPKSLAGPLSHHNTREGYRTQVKGPWHSEELEIRFEECPGTKVHVEETCGTRGPSLRSTTASGRVIEEWCCRECTMPPLSFRAKDGCWYGMEIRPRKEPESNLVRSMVTAGSTDHMDHFSLGVLVILLMVQEGLKKRMTTKIIMSTSMAVLVAMVLGGFSMSDLAKLVILMGATFAEMNTGGDVAHLALVAAFKVRPALLVSFIFRANWTPRESMLLALASCLLQTAISALEGELMVLVNGFALAWLAIRAMAVPRTDNIALAILAALTPLARGTLLVAWRAGLATCGGFMLLSLKGKGSVKKNLPFVMALGLTAVRIVDPINVVGLLLLTRSGKRSWPPSEVLTAVGLICALAGGFAKADIEMAGPMAAVGLLIVSYVVSGKSVDMYIERAGDITWEKDXEVTGNSPRLDVALDESGDFSLVEEDGPPMREIILKVVLMAICGMNPIAIPFAAGAWYVYVKTGKRSGALWDVPAPKEVKKGETTDGVYRVMTRRLLGSTQVGVGVMQEGVFHTMWHVTKGAALRSGEGRLDPYWGDVKQDLVSYCGPWKLDAAWDGLSEVQLLAVPPGERARNIQTLPGIFKTKDGDIGAVALDYPAGTSGSPILDKCGRVIGLYGNGVVIKNGSYVSAITQGKREEEAPVECFEPSMLRKKQLTVLDLHPGAGKTRRVLPEIVREAIKKRLRTLILAPTRVVAAEMEEALRGLXVRYMTTAVNVTHSGTEIVDLMCHATFTSRLLQPIRVPNYNLNIMDEAHFTDPSSIAARGYISTRVEMGEAAAIFMTATPPGTRDAFPDSNSPIMDTEVEVPERAWSSGFDWVTDHSGKTIWFVPSVRSGEESAACLTKAGKRVIQLSRKTFETEFQKTKNQEWDFVITTDISEMGANFKADRVIDSRRCLKPVILDGERVILAGPMPVTHASAAQRRGRIGRNPNKPGDEYMYGGGCAETDEDHAHWLEARMLLDNIYLQDGLIASLYRPEADKVAAIEGEFKLRTEQRKTFVELMKRGDLPVWLAYQVASAGITYTDRRWCFDGTTNNTIMEDSVPAEVWTKYGEKRVLKPRWMDARVCSDHAALKSFKEFAAGKRGAALGVMDALGTLPGHMTERFQEAIDNLAVLMRAETGSRPYKAAAAQLPETLETIMLLGLLGTVSLGIFFVLMRNKGIGKMGFGMVTLGASAWLMWLSEIEPARIACVLIVVFLLLVVLIPEPEKQRSPQDNQMAIIIMVAVGLLGLITANELGWLERTKSDIAHLMGRKEEGTTIGFSMDIDLRPASAWAIYAALTTLITPAVQHAVTTSYNNYSLMAMATQAGVLFGMGKGMPFYAWDFGVPLLMMGCYSQLTPLTLIVAIILLVAHYMYLIPGLQAAAARAAQKRTAAGIMKNPVVDGIVVTDIDTMTIDPQVEKKMGQVLLIAVAVSSAVLLRTAWGWGEAGALITAATSTLWEGSPNKYWNSSTATSLCNIFRGSYLAGASLIYTVTRNAGLVKRRGGGTGETLGEKWKARLNQMSALEFYSYKKSGITEVCREEARRALKDGVATGGHAVSRGSAKLRWLVERGYLQPHGKVVDLGCGRGGWSYYAATIRKVQEVRGYTKGGPGHEEPMLVQSYGWNIVRLKSGVDVFHMAAEPCDTLLCDIGESSSSPEVEETRTLRVLSMVGDWLEKRPGAFCIKVLCPYTSTMMETMERLQRRHGGGLVRVPLSRNSTHEMYWVSGAKSNIIKSVSTTSQLLLGRMDGPRRPVKYEEDVNLGSGTRAVASCAEAPNMKIIGRRIERIRNEHAETWFFDENHPYRTWAYHGSYEAPTQGSASSLVNGVVRLLSKPWDVVTGVTGIAMTDTTPYGQQRVFKEKVDTRVPDPQEGTRQVMNMVSSWLWKELGKRKRPRVCTKEEFINKVRSNAALGAIFEEEKEWKTAVEAVNDPRFWALVDKEREHHLRGECHSCVYNMMGKREKKQGEFGKAKGSRAIWYMWLGARFLEFEALGFLNEDHWMGRENSGGGVEGLGLQRLGYILEEMNRAPGGKMYADDTAGWDTRISKFDLENEALITNQMEEGHRALALAVIKYTYQNKVVKVLRPAEGGKTVMDIISRQDQRGSGQVVTYALNTFTNLVVQLIRNMEAEEVLEMHDLWLLRKPEKVTRWLQSNGWDRLKRMAVSGDDCVVKPIDDRFAHALRFLNDMGKVRKDTQEWKPSTGWSNWEEVPFCSHHFNKLHLKDGRSIVVPCRHQDELIGRARVSPGAGWSIRETACLAKSYAQMWQLLYFHKRDLRLMANAICSAVPVDWVPTGRTTWSIHGKGEWMTTEDMLMVWNRVWIEENDHMEDKTPVTKWTDIPYLGKREDLWCGSLIGHRPRTTWAENIKDTVNMVRRIIGDEEKYMDYLSTQVRYLGEEGSTPGVL

SEQ ID NO: 98 - protein, 3423 aa, Zika virus
  Strain ArB1362 polyprotein
  misc_feature (446)..(452): Xaa can be any naturally occurring amino acid
  misc_feature (1742)..(1742): Xaa can be any naturally occurring amino acid
  misc_feature (2983)..(2983): Xaa can be any naturally occurring amino acid
MKNPKKKSGGFRIVNMLKRGVARVNPLGGLKRLPAGLLLGHGPIRMVLAILAFLRFTAIKPSLGLINRWGSVGKKEAMEIIKKFKKDLAAMLRIINARKERKRRGADTSIGIIGLLLTTAMAAEITRRGSAYYMYLDRSDAGKAISFATTLGVNKCHVQIMDLGHMCDATMSYECPMLDEGVEPDDVDCWCNTTSTWVVYGTCHHKKGEARRSRRAVTLPSHSTRKLQTRSQTWLESREYTKHLIKVENWIFRNPGFALAAVAIAWLLGSSTSQKVIYLIMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIVNDXXXXXXXNRAEVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQYAGTDGPCKVPAQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSADVGCSVDFSKRETRCGTGVFVYNDVEAWRDRYKYHPDSPRRLAAAVKQAWEEGICGISSVSRMENIMWKSVEGELNAILEENGVQLTVVVGSVKNPMWRGPQRLPVPVNELPHGWKAWGKSYFVRAAKTNNSFVVDGDTLKECPLKHRAWNSFLVEDHGFGVFHTSVWLKVREDYSLECDPAVIGTAVKGKEAAHSDLGYWIESEKNDTWRLKRAHLIEMKTCEWPKSHTLWTDGVEESDLIIPKSLAGPLSHHNTREGYRTQAKGPWHSEELEIRFEECPGTKVHVEETCGTRGPSLRSTTASGRVIEEWCCRECTMPPLSFRAKDGCWYGMEIRPRKEPESNLVRSMVTAGSTDHMDHFSLGVLVILLMVQEGLKKRMTTKIIVSTSMAVLVAMILGGFSMSDLAKLVILMGATFAEMNTGGDVAHLALVAAFKVRPALLVSFIFRANWTPRESMLLALASCLLQTAISALEGDLMVLVNGFALAWLAIRAMAVPRTDNIALAILAALTPLARGTLLVAWRAGLATCGGFMLLSLKGKGSVKKNLPFVMALGMTAVRIVDPINVVGLLLLTRSGKRSWPPSEVLTAVGLICALAGGFAKADIEMAGPMAAVGLLIVSYVVSGKSVDMYIERAGDITWEKDAEVTGNSPRLDVALDESGDFSLVEEDGPPMREIILKVVLMAICGMNPIAIPFAAGAWYVYVKTGKRSGALWDVPAPKEVKKGETTDGVYRVMTRRLLGSTQVGVGVMQEGVFHTMWHVTKGAALRSGEGRLDPYWGDVKQDLVSYCGPWKLDAAWDGLSEVQLLAVPPGERARNIQTLPGIFKTKDGDIGAVALDYPAGTSGSPILDKCGRVIGLYGNGVVIKNGSYVSAITQGKREEETPVECFEPSMLKKKQLTVLDLHPGAGKTRRVLPEIVREAIKKRLRTVILAPTRVVAAEMEEALRGLXVRYMTTAVNVTHSGTEIVDLMCHATFTSRLLQPIRVPNYNLNIMDEAHFTDPSSIAARGYISTRVEMGEAAAIFMTATPPGTRDAFPDSNSPIMDTEVEVPERAWSSGFDWVTDHSGKTVWFVPSVRNGNEITACLTKAGKRVIQLSRKTFETEFQKTKNQEWDFVITTDISEMGANFKADRVIDSRRCLKPVILDGERVILAGPMPVTHASAAQRRGRIGRNPNKPGDEYMYGGGCAETDEDHAHWLEARMLLDNIYLQDGLIASLYRPEADKVAAIEGEFKLRTEQRKTFVELMKRGDLPVWLAYQVASAGITYTDRRWCFDGTTNNTIMEDSVPAEVWTKYGEKRVLKPRWMDARVCSDHAALKSFKEFAAGKRGAALGVMEALGTLPGHMTERFQEAIDNLAVLMRAETGSRPYKAAAAPLPETLETIMLLGLLGTVSLGIFFVLMRNKGIGKMGFGMVTLGASAWLMWLSEIEPARIACVLIVVFLLLVVLIPEPEKQRSPQDNQMAIIIMVAVGLLGLITANELGWLERTKNDIAHLMGRREEGVTMGFSMDIDLRPASAWAIYAALTTLITPAVQHAVTTSYNNYSLMAMATQAGVLFGMGKGMPFYAWDFGVPLLMMGCYSQLTPLTLIVAIILLVAHYMYLIPGLQAAAARAAQKRTAAGIMKNPVVDGIVVTDIDTMTIDPQVEKKMGQVLLIAVAISSAVLLRTAWGWGEAGALITAATSTLWEGSPNKYWNSSTATSLCNIFRGSYLAGASLIYTVTRNAGLVKRRGGGTGETLGEKWKARLNQMSALEFYSYKKSGITEVCREEARRALKDGVATGGHAVSRGSAKLRWLVERGYLQPHGKVVDLGCGRGGWSYYAATIRKVQEVKGYTKGGPGHEEPMLVQSYGWNIVRLKSGVDVFHMAAEPCDTLLCDIGESSSSPEVEETRTLRVLSMVGDWLEKRPGAFCIKVLCPYTSTMMETMERLQRRYGGGLVRVPLSRNSTHEMYWVSGAKSNIIKSVSTTSQLLLGRMDGPRRPVKYEEDVNLGSGTRAVASCAEAPNMKIIGKRIERIRSEHAETWFFDENHPYRTWAYHGSYEAPTQGSASSLVNGVVRLLSKPWDVVTGVTGIAMTDTTPYGQQRVFKEKVDTRVPDPQEGTRQTMNMVSSWLWKELGKRKRPRVCTKEEFINKVRSNAALGAIFEEEKEWKTAVEAVNDPRFWALVDKEREHHLRGECHSCVYNMMGKREKKXGEFGKAKGSRAIWYMWLGARFLEFESLGFLNEDHWMGRENSGGGVEGLGLQRLGYILEEMNRAPGGKMYADDTAGWDTRISKFDLENEALITNQMEEGHRALALAVIKYTYQNKVVKVLRPAEGGKTVMDIISRQDQRGSGQVVTYALNTFTNLVVQLIRNMEAEEVLEMQDLWLLRKPEKVTRWLQSNGWDRLKRMAVSGDDCVVKPIDDRFACCLRFLNDMGKVRKDTQEWKPSTGWSNWEEVPFCSHHFNKLHLKDGRSIVVPCRHQDELIGRARVSPGAGWSIRETACLAKSYAQMWQLLYFHRRDLRLMANAICSAVPVDWVPTGRTTWSIHGKGEWMTTEDMLMVWNRVWIEENDHMEDKTPVTKWTDIPYLGKREDLWCGSLIGHRPRTTWAENIKDTVNMVRRIIGDEEKYMDYLSTQVRYLGEEGSTPGVL

SEQ ID NO: 99 - protein, 3423 aa, Zika virus
  POLYPROTEIN GENBANK: EU545988.1
  misc_feature (845)..(845): Xaa can be any naturally occurring amino acid
  misc_feature (2121)..(2121): Xaa can be any naturally occurring amino acid
MKNPKEEIRRIRIVNMLKRGVARVSPFGGLKRLPAGLLLGHGPIRMVLAILAFLRFTAIKPSLGLINRWGSVGKKEAMEIIKKFKKDLAAMLRIINARKEKKRRGTDTSVGIVGLLLTTAMAVEVTRRGSAYYMYLDRSDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPAVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLVWLGLNTKNGSISLTCLALGGVLIFLSTAVSADVGCSVDFSKKETRCGTGVFVYNDVDAWRDRYKYHPDSPRRLAAAVKQAWXDGICGISSVSRMENIMWRSVEGELNAILEENGVQLTVVVGSVKNPMWRGPQRLPVPVNELPHGWKAWGKSYFVRAAKTNNSFVVDGDTLKECPLKHRAWNSFLVEDHGFGVFHTSVWLKVREDYSLECDPAVIGTAAKGKEAVHSDLGYWIESEKNDTWRLKRAHLIEMKTCEWPKSHTLWTDGIEESDLIIPKSLAGPLSHHNTREGYRTQMKGPWHSEELEIRFEECPGTKVHVEETCGTRGPSLRSTTASGRVIEEWCCRECTMPPLSFRAKDGCWYGMEIRPRKEPESNLVRSMVTAGSTDHMDHFSLGVLVILLMVQEGLKKRMTTKIIISTSMAVLVAMILGGFSMSDLAKLAILMGATFAEMNTGGDVAHLALIAAFKVRPALLVSFIFRANWTPRESMLLALASCLLQTAISALEGDLMVLINGFALAWLAIRAMVVPRTDNITLAILTALTPLARGTLLVAWRAGLATCGGFMLLSLKGKGSVKKNLPFVMALGLTAVRLVDPINVVGLLLLTRSGKRSWPPSEVLTAVGLICALAGGFAKADIEMAGPMAAVGLLIVSYVVSGKSVDMYIERAGDITWEKDAEVTGNSPRLDVALDESGDFSLVEDDGPPMREIILKVVLMTICGMNPIAIPFAAGAWYVYVKTGKRSGALWDVPAPKEVKKGETTDGVYRVMTRRLLGSTQVGVGVMQEGVFHTMWHVTKGSALRSGEGRLDPYWGDVKQDLVSYCGPWKLDAAWDGHSEVQLLAVPPGERARNIQTPPGIFKTKDGDIGAVALDYPAGTSGSPILDKCGRVIGLYGNGVVIKNGSYVSAITQGRREEETPVECFEPSMLKKKQLTVLDLHPGAGKTRRVLPEIVREAIKTRLRTVILAPTRVVAAEMEEALRGLPVRYMTTAVNVTHSGTEIVDLMCHATFTSRLLQPIRVPNYNLYIMDEAHFTDPSSIAARGYISTRVEMGEAAAIFMTATPPGTRDAFPDSNSPIMDTEVEVPERAWSSGFDWVTDHSGKTVWFVPSVRNGNEIAACLTKAGKRVIQLSRKTFETEFLKTKNQEWDFVVTTDISEMGANFKADRVIDSRRCLKPVILDGERVILAGPMPVTHASAAQRRGRIGRNPNKPGDEYLYGGGCAETDEDHAHWLEARMLLDNIYLQDGLIASLYRPEADKVAAIEGEFKLRTEQRKTFVELMKRGDLPVWLAYQVASAGITYTDRKWCFDGTTNNTIMEDSVPAEVWTRYGEKRVLKPRWMDARVCSDHAALKSFKEFAAGKRGXAFGVMEALGTLPGHMTERFQEAIDNLAVLMRAETGSRPYEAAAAQLPETLETIMLLGLLGTVSLGIFFVLMRNKGIGKMGFGMVTLGASAWLMWLSEIEPARIACVLIVVFLLLVVLIPEPEKQRSPQDNQMAIIIMIAVGLLGLITANELGWLERTKSDLSHLMGRREEGATIGFSMDIDLRPASAWAIYAALTTFITPAVQHAVTTSYNNYSLMAMATQAGVLFGMGKGMPFYAWDFGVPLLMMGCYSQLTPLTLIVAIILLVAHYMYLIPGLQAAAARAAQKRTAAGIMKNPVVDGIVVTDIDTMTIDHRVEKKMGQVLLIAVAVSSAILSRTAWGWGEAGALITAATSTLWEGSPNKYWNSSTATSLCNIFRGSYLAGASLIYTVTRNAGLVKRRGGGTGETLGEKWKARLNQMSALEFYSYKKSGITEVCREEARRALKDGVATGGHAVSRGSAKLRWLVERGYLQPYGKVIDLGCGRGGWSYYAATIRKVQEVKGYTKGGPGHEEPMLVQSYGWNIVRLKSGVDVFHMAAEPCDTLLCDIGESSSSPEVEEARTLRVLSMVGDWLEKRPGAFCIKVLCPYTSTMMETLERLQRRYGGGLVRVPLSRNSTHEMYWVSGAKSNTIKSVSTTSQLLLGRMDGPRRPVKYEEDVNLGSGTRAVVSCAEAPNMKIIGNRIERIRSEHAETWFFDENHPYRTWAYHGSYEAPTQGSASSLINGVVRLLSKPWDVVTGVTGIAMTDTTPYGQQRVFKEKVDTRVPDPQEGTRQVMSMVSSWLWKELGKHKRPRVCTKEEFINKVRSNAALGAIFEEEKEWKTAVEAVNDPRFWALVDKEREHHLRGECQSCVYNMMGKREKKQGEFGKAKGSRAIWYMWLGARFLEFEALGFLNEDHWMGRENSGGGVEGLGLQRLGYVLEEMSRIPGGRMYADDTAGWDTRISRFDLENEALITNQMEKGHRALALAIIKYTYQNKVVKVLRPAEKGKTVMDIISRQDQRGSGQVVTYALNTFTNLVVQLIRNMEAEEVLEMQDLWLLRRSEKVTNWLQSNGWDRLKRMAVSGDDCVVKPIDDRFAHALRFLNDMGKVRKDTQEWKPSTGWDNWEEVPFCSHHFNKLHLKDGRSIVVPCRHQDELIGRARVSPGAGWSIRETACLAKSYAQMWQLLYFHRRDLRLMANAICSSVPVDWVPTGRTTWSIHGKGEWMTTEDMLVVWNRVWIEENDHMEDKTPVTKWTDIPYLGKREDLWCGSLIGHRPRTTWAENIKNTVNMMRRIIGDEEKYMDYLSTQVRYLGEEGSTPGVL

SEQ ID NO: 100 - protein, 3423 aa, Zika virus
  Isolate Zika virus/H.sapiens-tc/PHL/2012/CPC-0740
MKNPKKKSGGFRIVNMLKRGVARVSPFGGLKRLPAGLLLGHGPIRMVLAILAFLRFTAIKPSLGLINRWGSVGKKEAMEIIKKFKKDLAAMLRIINARKEKKRRGADTSVGIVGLLLTTAMAVEVTRRGSAYYMYLDRSDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAVIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLVWLGLNTKNGSISLTCLALGGVLIFLSTAVSADVGCSVDFSKKETRCGTGVFVYNDVEAWRDRYKYHPDSPRRLAAAVKQAWEDGICGISSVSRMENIMWRSVEGELNAILEENGVQLTVVVGSVKNPMWRGPQRLPVPVNELPHGWKAWGKSYFVRAAKTNNSFVVDGDTLKECPLKHRAWNSFLVEDHGFGVFHTSVWLKVREDYSLECDPAVIGTAAKGKEAVHSDLGYWIESEKNDTWRLKRAHLIEMKTCEWPKSHTLWTDGVEESDLIIPKSLAGPLSHHNTREGYRTQMKGPWHSEELEIRFEECPGTKVHVEETCGTRGPSLRSTTASGRVIEEWCCRECTMPPLSFRAKDGCWYGMEIRPRKEPESNLVRSMVTAGSTDHMDHFSLGVLVILLMVQEGLKKRMTTKIIISTSMAVLVAMILGGFSMSDLAKLAILMGATFAEMNTGGDVAHLALIAAFKVRPALLVSFIFRANWTPRESMLLALASCLLQTAISALEGDLMVLINGFALAWLAIRAMVVPRTDNITLAILAALTPLARGTLLVAWRAGLATCGGFMLLSLKGKGSVKKNLPFVMALGLTAVRLVDPINVVGLLLLTRSGKRSWPPSEVLTAVGLICALAGGFAKADIEMAGPMAAVGLLIVSYVVSGKSVDMYIERAGDITWEKDAEITGNSPRLDVALDESGDFSLVEDDGPPMREIILKVVLMTICGMNPIAIPFAAGAWYVYVKTGKRSGALWDVPAPKEVKKGETTDGVYRVMTRRLLGSTQVGVGVMQEGVFHTMWHVTKGSALRSGEGRLDPYWGDVKQDLVSYCGPWKLDAAWDGHSEVQLLAVPPGERARNIQTLPGTFKTKDGDIGAVALDYPAGTSGSPILDKCGRVIGLYGNGVVIKNGSYVSAITQGRREEETPVECFEPSMLKKKQLTVLDLHPGAGKTRRVLPEIVREAIKTRLRTVILAPTRVVAAEMEEALRGLPVRYMTTAVNVTHSGTEIVDLMCHATFTSRLLQPIRVPNYNLYIMDEAHFTDPSSIAARGYISTRVEMGEAAAIFMTATPPGTRDAFPDSNSPIMDTEVEVPERAWSTGFDWVTDHSGKTVWFVPSVRNGNEIAACLTKAGKRVIQLSRKTFETEFQKTKNQEWDFVVTTDISEMGANFKADRVIDSRRCLKPVILDGERVILAGPMPVTHASAAQRRGRIGRNPNKPGDEYLYGGGCAETDEDHAHWLEARMLLDNIYLQDGLIASLYRPEADKVAAIEGEFKLRTEQRKTFVELMKRGDLPVWLAYQVASAGITYTDRRWCFDGMTNNTIMEDSVPAEVWTRYGEKRVLKPRWMDARVCSDHAALKSFKEFAAGKRGAAFGVIEALGTLPGHMTERFQEAIDNLAVLMRAETGSRPYKAAAAQLPETLETIMLLGLLGTVSLGIFFVLMRNKGMGKMGFGMVTLGASAWLMWLSEIEPARIACVLIVVFLLLVVLIPEPEKQRSPQDNQMAIIIMVAVGLLGLITANELGWLERTKSDLSHLMGRREEGATTGFSMDIDLRPASAWAIYAALTTFITPAVQHAVTTSYNNYSLMAMATQAGVLFGMGKGMPFYAWDFGVPLLMMGCYSQLTPLTLIVAIILLVAHYMYLIPGLQAAAARAAQKRTAAGIMKNPVVDGIVVTDIDTMTIDPQVEKKMGQVLLIAVAVSSAILSRTAWGWGEAGALITAATSTLWEGSPNKYWNSSTATSLCNIFRGSYLAGASLIYTVTRNAGLVKRRGGGTGETLGEKWKARLNQMSALEFYSYKKSGITEVCREEARRALKDGVATGGHAVSRGSAKLRWLVERGYLQPYGKVIDLGCGRGGWSYYAATIRKVQEVKGYTKGGPGHEEPMLVQSYGWNIVRLKSGVDVFHMAAEPCDTLLCDIGESSSSPEVEEARTLRVLSMVGDWLEKRPGAFCIKVLCPYTSTMMETLERLQRRYGGGLVRVPLSRNSTHEMYWVSGAKSNTIKSVSTTSQLLLGRMDGPRRPVKYEEDVNLGSGTRAVVSCAEAPNMKIIGNRIERIRSEHAETWFFDENHPYRTWAYHGSYEAPTQGSASSLINGVVRLLSKPWDVVTGVTGIAMTDTTPYGQQRVFKEKVDTRVPDPQEGTRQVMSMVSSWLWKELGKHKRPRVCTKEEFINKVRSNAALGAIFEEEKEWKTAVEAVNDPRFWALVDKEREHHLRGECQSCVYNMMGKREKKQGEFGKAKGSRAIWYMWLGARFLEFEALGFLNEDHWMGRENSGGGVEGLGLQRLGYVLEEMSRIPGGRMYADDTAGWDTRISRFDLENEALITNQMEKGHRALALAIIKYTYQNKVVKVLRPAEKGKTVMDIISRQDQRGSGQVVTYALNTFTNLVVQLIRNMEAEEVLEMQDLWLLRRPEKVTNWLQSNGWDRLKRMAVSGDDCVVKPIDDRFAHALRFLNDMGKVRKDTQEWKPSTGWDNWEEVPFCSHHFNKLHLKDGRSIVVPCRHQDELIGRARVSPGAGWSIRETACLAKSYAQMWQLLYFHRRDLRLMANAICSSVPVDWVPTGRTTWSIHGKGEWMTTEDMLVVWNRVWIEENDHMEDKTPVTKWTDIPYLGKREDLWCGSLIGHRPRTTWAENIKNTVNMMRRIIGDEEKYMDYLSTQVRYLGEEGSTPGVL

SEQ ID NO: 101 - protein, 3423 aa, Zika virus
  Isolate Zika virus/H.sapiens-tc/THA/2014/SV0127- 14
MKNPKKKSGGFRIVNMLKRGVARVSPFGGLKRLPAGLLLGHGPIRMVLAILAFLRFTAIKPSLGLINRWGSVGKKEAMEIIKKFKKDLAAMLRIINARKEKKRRGTDTSVGIVGLLLTTAMAAEVTRRGSAYYMYLDRSDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHTGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITEGTENSKMMLELDPPFGDSYIVIGVGEKKITHHWHRSGSTIGKAFEATVRGAKRMAVLGDTAWDFGSVGGVLNSLGKGIHQIFGAAFKSLFGGMSWFSQILIGTLLMWLGLNTKNGSISLMCLALGGVLIFLSTAVSADVGCSVDFSKKETRCGTGVFVYNDVEAWRDRYKYHPDSPRRLAAVVKQAWEDGICGISSVSRMENIMWRSVEGELNAILEENGVQLTVVVGSVKNPMWRGPQRLPVPVNELPHGWKAWGKSYFVRAAKTNNSFVVDGDTLKECPLKHRAWNSFLVEDHGFGVFHTSVWLKVREDYSLECDPAVIGTAVKGKEAVHSDLGYWIESEKNDTWRLRRAHLIEMKTCEWPKSHTLWTDGIEESDLIIPKSLAGPLSHHNTREGYRTQMKGPWHSEELEIRFEECPGTKVHVEETCGTRGPSLRSTTASGRVIEEWCCRECTMPPLSFRAKDGCWYGMEIRPRKEPESNLVRSMVTAGSTDHMDHFSLGVLVILLMVQEGLKKRMTTKIIISTSMAVLVAMILGGFSMSDLAKLAILMGATFAEMNTGGDVAHLALVAAFKVRPALLVSFIFRANWTPRESMLLALASCLLQTAISALEGDLMVLINGFALAWLAIRAMVVPRTDNITLAILAALTPLARGTLLVAWRAGLATCGGFMLLSLKGKGSVKKNLPFVMALGLTAVRLVDPINVVGLLLLTRSGKRSWPPSEVLTAVGLICALAGGFAKADIEMAGPMAAVGLLIVSYVVSGKSVDMYIERAGDITWEKDAEVTGNSPRLDVALDESGDFSLVEDDGPPMREIILKVVLMTICGMNPIAIPFAAGAWYVYVKTGKRSGALWDVPAPKEVKKGETTDGVYRVMTRRLLGSTQVGVGVMQEGVFHTMWHVTKGSALRSGEGRLDPYWGDVKQDLVSYCGPWKLDAAWDGHSEVQLLAVPPGERARNIQTLPGIFKTKDGDIGAVALDYPAGTSGSPILDKCGRVIGLYGNGVVIKNGSYVSAITQGRREEETPVECFEPSMLKKKQLTVLDLHPGAGKTRRVLPEIVREAIKTRLRTVILAPTRVVAAEMEEALRGLPVRYMTTAVNVTHSGTEIVDLMCHATFTSRLLQPIRVPNYNLYIMDEAHFTDPSSIAARGYISTRVEMGEAAAIFMTATPPGTRDAFPDSNSPIMDTEVEVPERAWSSGFDWVTDHSGKTVWFVPSVRNGNEIAACLTKAGKRVIQLSRKTFETEFQKTKHQEWDFVVTTDISEMGANFKADRVIDSRRCLKPVILDGERVILAGPMPVTHASAAQRRGRIGRNPNKPGDEYLYGGGCAETDEDHAHWLEARMLLDNIYLQDGLIASLYRPEADKVAAIEGEFKLRTEQRKTFVELMKRGDLPVWLAYQVASAGITYTDRRWCFDGMTNNTIMEDSVPAEVWTRHGEKRVLKPRWMDARVCSDHAALKSFKEFAAGKRGAAFGVMEALGTLPGHMTERFQEAIDNLAVLMRAETGSRPYKAAAAQLPETLETIMLLGLLGTVSLGIFFVLMRNKGIGKMGFGMVTLGASAWLMWLSEIEPARIACVLIVVFLLLVVLIPEPEKQRSPQDNQMAIIIMVAVGLLGLITANELGWLERTKSDLSHLMGRREEGATIGFSMDIDLRPASAWAIYAALTTFITPAVQHAVTTSYNNYSLMAMATQAGVLFGMGKGMPFYAWDFGVPLLMIGCYSQLTPLTLIVAIILLVAHYMYLIPGLQAAAARAAQKRTAAGIMKNPVVDGIVVTDIDTMTIDPQVEKKMGQVLLIAVAVSSAILSRTAWGWGEAGALITAATSTLWEGSPNKYWNSSTATSLCNIFRGSYLAGASLIYTVTRNAGLVKRRGGGTGETLGEKWKARLNQMSALEFYSYKKSGITEVCREEARRALKDGVATGGHAVSRGSAKLRWLVERGYLQPYGKVIDLGCGRGGWSYYAATIRKVQEVKGYTKGGPGHEEPMLVQSYGWNIVRLKSGVDVFHMAAEPCDTLLCDIGESSSSPEVEEARTLRVLSMVGDWLEKRPGAFCVKVLCPYTSTMMETLERLQRRYGGGLVRVPLSRNSTHEMYWVSGAKSNTIKSVSTTSQLLLGRMDGPRRPVKYEEDVNLGSGTRAVVSCAEAPNMKIIGNRIERIRSEHAETWFFDENHPYRTWAYHGSYEAPTQGSASSLINGVVRLLSKPWDVVTGVTGIAMTDTTPYGQQRVFKEKVDTRVPDPQEGTRQVMSMVSSWLWKELGKHKRPRVCTKEEFINKVRSNAALGAIFEEEKEWKTAVEAVNDPRFWALVDKEREHHLRGECQSCVYNMMGKREKKQGEFGKAKGSRAIWYMWLGARFLEFEALGFLNEDHWMGRENSGGGVEGLGLQRLGYVLEEMSRIPGGRMYADDTAGWDTRISRFDLENEALITNQMEKGHRALALAIIKYTYQNKVVKVLRPAEKGKTVMDIISRQDQRGSGQVVTYALNTFTNLVVQLIRNMEAEEVLEMQDLWLLRRSEKVTNWLQSNGWDRLKRMAVSGDDCVVKPIDDRFAHALRFLNDMGKVRKDTQEWKPSTGWDNWEEVPFCSHHFNKLHLKDGRSIVVPCRHQDELIGRARVSPGAGWSIRETACLAKSYAQMWQLLYFHRRDLRLMANAICSSVPVDWVPTGRTTWSIHGKGEWMTTEDMLVVWNRVWIEENDHMEDKTPVTKWTDIPYLGKREDLWCGSLIGHRPRTTWAENIKNTVNMVRRIIGDEEKYMDYLSTQVRYLGEEGSTPGVL

SEQ ID NO: 102 - protein, 3422 aa, Zika virus
  Isolate ARB7701 polyprotein
  misc_feature (1167)..(1167): Xaa can be any naturally occurring amino acid
MKNPKKKSGGFRIVNMLKRGVARVNPLGGLKRLPAGLLLGHGPIRMVLAILAFLRFTAIKPSLGLINRWGSVGKKEAMEIIKKFKKDLAAMLRIINARKERKRRGADTSIGIIGLLLTTAMAAEITRRGSAYYMYLDRSDAGKAISFATNLGVNKCHVQIMDLGHMCDATMSYECPMLDEGVEPDDVDCWCNTTSTWVVYGTCHHKKGEARRSRRAVTLPSHSTRKLQTRSQTWLESREYTKHLIKVENWIFRNPGFALAAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIVNDIGHETDENRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQYAGTDGPCKVPAQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGVHQIFGAAFKSLFGGMSWFSQILIGTLLVWLGLNTKNGSISLTCLALGGVMIFLSTAVSADVGCSVDFSKRETRCGTGVFVYNDVEAWRDRYKYHPDSPRRLAAAVKQAWEEGICGISSVSRMENIMWKSVEGELNAILEENGVQLTVVVGSVKNPMWRGPQRLPVPVNELPHGWKAWGKSYFVRAAKTNNSFVVDGDTLKECPLKHRAWNSFLVEDHGFGVFHTSVWLKVREDYSLECDPAVIGTAVKGKEAAHSDLGYWIESEKNDTWRLKRAHLIEMKTCEWPKSHTLWTDGVEESDLIIPKSLAGPLSHHNTREGYRTQAKGPWHSEELEIRFEECPGTKVHVEETCGTRGPSLRSTTASGRVIEEWCCRECTMPPLSFRAKDGCWYGMEIRPRKEPESNLVRSMVTAGSTDHMDHFSLGVLVILLMVXEGLKKRMTTKIIMSTSMAVLVAMILGGFLMSDLAKLVILMGATFAEMNTGGDVAHLALVAAFKVRPALLVSFIFRANWTPRESMLLALASCLLQTAISALEGDLMVLVNGFALAWLAIRAMAVPRTDNIALAILAALTPLARGTLLVAWRAGLATCGGFMLLSLKGKGSVKKNLPFVMALGLTAVRIVDPINVVGLLLLTRSGKRSWPPSEVLTAVGLICALAGGFAKADIEMAGPMAAVGLLIVSYVVSGKSVDMYIERAGDITWEKDAEVTGNSPRLDVALDESGDFSLVEEDGPPMREIILKVVLMAICGMNPIAIPFAAGAWYVYVKTGKRSGALWDVPAPKEVKKGETTDGVYRVMTRRLLGSTQVGVGVMQEGVFHTMWHVTKGAALRSGEGRLDPYWGDVKQDLVSYCGPWKLDAAWDGLSEVQLLAVPPGERARNIQTLPGIFKTKDGDIGAVALDYPAGTSGSPILDKCGRVIGLYGNGVVIKNGSYVSAITQGKREEETPVECFEPSMLKKKQLTVLDLHPGAGKTRRVLPEIVREAIKKRLRTVILAPTRVVAAEMEEALRGLPVRYMTTAVNVTHSGTEIVDLMCHATFTSRLLQPIRVPNYNLYIMDEAHFTDPSSIAARGYISTRVEMGEAAAIFMTATPPGTRDAFPDSNSPIMDTEVEVPERAWSSGFDWVTDHSGKTVWFVPSVRNGNEIAACLTKAGKRVIQLSRKTFETEFQKTKNQEWDFVITTDISEMGANFKADRVIDSRRCLKPVILDGERVILAGPMPVTHASAAQRRGRIGRNPNKPGDEYMYGGGCAETDEDHAHWLEARMLLDNIYLQDGLIASLYRPEADKVAAIEGEFKLRTEQRKTFVELMKRGDLPVWLAYQVASAGITYTDRRWCFDGTTNNTIMEDSVPAEVWTKYGEKRVLKPRWMDARVCSDHAALKSFKEFAAGKRGVALGVMEALGTLPGHMTERFQEAIDNLAVLMRAETGSRPYKAAAAQLPETLETIMLLGLLGTVSLGIFFVLMRNKGIGKMGFGMVTLGASAWLMWLSEIEPARIACVLIVVFLLLVVLIPEPEKQRSPQDNQMAIIIMVAVGLLGLITANELGWLERTKNDIAHLMGRREEGVTMGFSMDIDLRPASAWAIYAALTTLITPAVQHAVTTSYNNYSLMAMATQAGVLFGMGKGMPFYAWDFGVPLLMMGCYSQLTPLTLIVAIILLVAHYMYLIPGLQAAAARAAQKRTAAGIMKNPVVDGIVVTDIDTMTIDPQVEKKMGQVLLIAVAISSAVLLRTAWGWGEAGALITAATSTLWEGSPNKYWNSSTATSLCNIFRGSYLAGASLIYTVTRNAGLVKRRGGGTGETLGEKWKARLNQMSALEFYSYKKSGITEVCREEARRALKDGVATGGHAVSRGSAKLRWLVERGYLQPHGKVVDLGCGRGGWSYYAATIRKVQEVKGYTKGGPGHEEPMLVQSYGWNIVRLKSGVDVFHMAAEPCDTLLCDIGESSSSPEVEETRTLRVLSMVGDWLEKRPGAFCIKVLCPYTSTMMETMERLQRRYGGGLVRVPLSRNSTHEMYWVSGAKSNVIKSVSTTSQLLLGRMDGPRRPVKYEEDVNLGSGTRAVASCAEAPNMKVIGKRIERIRSEHAETWFFDENHPYRTWAYHGSYEAPTQGSASSLVNGVVRLLSKPWDVVTGVTGIAMTDTTPYGQQRVFKEKVDTRVPDPQEGTRQAMNMVSSWLWKELGKRKRPRVCTKEEFINKVRSNAALGAIFEEEKEWKTAVEAVNDPRFWALVDKEREHHLRGECHSCVYNMMGKREKKQGEFGKAKGSRAIWYMWLGARFLEFEALGFLNEDHWMGRENSGGGVEGLGLQRLGYILEEMNRAPGGKMYADDTAGWDTRISKFDLENEALITNQMEEGHRALALAVIKYTKNKVVKVLRPAEGGKTVMDIISRQDQRGSGQVVTYALNTFTNLVVQLIRNMEAEEVLEMQDLWLLRKPEKVTRWLQCNGWDRLKRMAVSGDDCVVKPIDDRFAHALRFLNDMGKVRKDTQEWKPSTGWSNWEEVPFCSHHFNKLHLKDGRSIVVPCRHQDELIGRARVSPGAGWSIRETACLAKSYAQMWQLLYFHRRDLRLMANAICSAVPVDWVPTGRTTWSIHGKGEWMTTEDMLMVWNRVWIEENDHMEDKTPVTKWTDIPYLGKREDLWCGSLIGHRPRTTWAENIKDTVNMVRRIIGDEEKYMDYLSTQVRYLGEEGSTPGVL

SEQ ID NO: 103 - protein, 3417 aa, Zika virus
  Isolate ARB15076 polyprotein
MKNPKKKSGGFRIVNMLKRGVARVNPLGGLKRLPAGLLLGHGPIRMVLAILAFLRFTAIKPSLGLINRWGSVGKKEAMEIIKKFKKDLAAMLRIINARKERKRRGADTSIGIIGLLLTTAMAAEITRRGSAYYMYLDRSDAGKAISFATNLGVNKCHVQIMDLGHMCDATMSYECPMLDEGVEPDDVDCWCNTTSTWVVYGTCHHKKGEARRSRRAVTLPSHSTRKLQTRSQTWLESREYTKHLIKVENWIFRNPGFALAAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIVNDENRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQYAGTDGPCKVPAQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSADVGCSVDFSKRETRCGTGVFVYNDVEAWRDRYKYHPDSPRRLAAAVKQAWEEGICGISSVSRMENIMWKSVEGELNAILEENGVQLTVVVGSVKNPMWRGPQRLPVPVNELPHGWKAWGKSYFVRAAKTNNRFVVDGDTLKECPLKHRAWNSFLVEDHGFGVFHTSVWLKVREDYSLECDPAVIGTAVKGKEAAHSDLGYWIESEKNDTWRLKRAHLIEMKTCEWPKSHTLWTDGVEESDLIIPKSLAGPLSHHNTREGYRTQAKGPWHSEELEIRFEECPGTKVHVEETCGTRGPSLRSTTASGRVIEEWCCRECTMPPLSFRAKDGCWYGMEIRPRKEPESNLVRSMVTAGSTDHMDHFSLGVLVILLMVQEGLKKRMTTKIIMSTSMAVLVAMILGGFSMSDLAKLVILMGATFAEMNTGGDVAHLALVAAFKVRPALLVSFIFRANWTPRESMLLALASCLLQTAISALEGDLMVLVNGFALAWLAIRAMAVPRTDNIALAVLAALTPLARGTLLVAWRAGLATCGGFMLLSLKGKGSVKKNLPFVMALGLTAVRIVDPINVVGLLLLTRSGKRSWPPSEVLTAVGLICALAGGFAKADIEMAGPMAAVGLLIVSYVVSGKSVDMYIERAGDITWEKDAEVTGNSPRLDVALDESGDFSLVEEDGPPMREIILKVVLMAICGMNPIAIPFAAGAWYVYVKTGKRSGALWDVPAPKEVKKGETTDGVYRVMTRRLLGSTQVGVGVMQEGVFHTMWHVTKGAALRSGEGRLDPYWGDVKQDLVSYCGPWKLDAAWDGLSEVQLLAVPPGERARNIQTLPGIFKTKDGDIGAVALDYPAGTSGSPILDKCGRVIGLYGNGVVIKNGSYVSAITQGKREEETPVECFEPSMLKKKQLTVLDLHPGAGKTRRVLPEIVREAIKKRLRTVILAPTRVVAAEMEEALRGLPVRYMTTAVNVTHSGTEIVDLMCHATFTSRLLQPIRVPNYNLYIMDEAHFTDPSSIAARGYISTRVEMGEAAAIFMTATPPGTRDAFPDSNSPIMDTEVEVPERAWSSGFDWVTDHSGKTVWFVPSVRNGNEIAACLTKAGKRVIQLSRKTFETEFQKTKNQEWDFVITTDISEMGANFKADRVIDSRRCLKPVILDGERVILAGPMPVTHASAAQRRGRIGRNPNKPGDEYMYGGGCAETDEDHAHWLEARMLLDNIYLQDGLIASLYRPEADKVAAIEGEFKLRTEQRKTFVELMKRGDLPVWLAYQVASAGITYTDRRWCFDGTTNNTIMEDSVPAEVWTKYGEKRVLKPRWMDARVCSDHAALKSFKEFAAGKRGAALGVMEALGTLPGHMTERFQEAIDNLAVLMRAETGSRPYKAAAAQLPETLETIMLLGLLGTVSLGIFFVLMRNKGIGKMGFGMVTLGASAWLMWLSEIEPARIACVLIVVFLLLVVLIPEPEKQRSPQDNQMAIIIMVAVGLLGLITANELGWLERTKNDIAHLMGRREEGVTMGFSMDIDLRPASAWAIYAALTTLITPAVQHAVTTSYNNYSLMAMATQAGVLFGMGKGMPFYAWDFGVPLLMVGCYSQLTPLTLIVAIILLVAHYMYLIPGLQAAAARAAQKRTAAGIMKNPVVDGIVVTDIDTMTIDPQVEKKMGQVLLIAVAISSAVLLRTAWGWGEAGALITAATSTLWEGSPNKYWNSSTATSLCNIFRGSYLAGASLIYTVTRNAGLVKRRGGGTGETLGEKWKARLNQMSALEFYSYKKSGITEVCREEARRALKNGVATGGHAVSRGSAKLRWLVERGYLQPHGKVVDLGCGRGGWSYYAATIRKVQEVKGYTKGGPGHEEPMLVQSYGWNIVRLKSGVDVFHMAAEPCDTLLCDIGESSSSPEVEETRTLRVLSMVGDWLEKRPGAFCIKVLCPYTSTMMETMERLQRRYGGGLVRVPLSRNSTHEMYWVSGAKSNIIKSVSTTSQLLLGRMDGPRRPVKYEEDVNLGSGTRAVASCAEAPNMKIIGKRIERIRSEHAETWFFDENHPYRTWAYHGSYEAPTQGSASSLVNGVVRLLSKPWDVVTGVTGIAMTDTTPYGQQRVFKEKVDTRVPDPQEGTRQTMNMVSSWLWKELGKRKRPRVCTKEEFINKVRSNAALGAIFEEEKEWKTAVEAVNDPRFWALVDKEREHHLRGECHSCVYNMMGKREKKQGEFGKAKGSRAIWYMWLGARFLEFEALGFLNEDHWMGRENSGGGVEGLGLQRLGYILEEMNRAPGGKMYADDTAGWDTRISKFDLENEALITNQMEEGHRALALAVIKYTYQNKVVKVLRPAEGGKTVMDIISRQDQRGSGQVVTYALNTFTNLVVQLIRNMEAEEVLEMQDLWLLRKPEKVTRWLQCNGWDRLKRMAVSGDDCVVKPIDDRFAHALRFLNDMGKVRKDTQEWKPSTGWSNWEEVPFCSHHFNKLHLKDGRSIVVPCRHQDELIGRARVSPGAGWSIRETACLAKSYAQMWQLLYFHRRDLRLMANAICSAVPVDWVPTGRTTWSIHGKGEWMTTEDMLMVWNRVWIEENDHMEDKTPVTKWTDIPYLGKREDLWCGSLIGHRPRTTWAENIKDTVNMVRRIIGDEEKYMDYLSTQVRYLGEEGSTPGVL

SEQ ID NO: 104 - protein, 3422 aa, Zika virus
  Isolate ARB13565 polyprotein
MKNPKKKSGGFRIVNMLKRGVARVNPLGGLKRLPAGLLLGHGPIRMVLAILAFLRFTAIKPSLGLINRWGSVGKKEAMEIIKKFKKDLAAMLRIINARKERKRRGADTSIGIIGLLLTTAMAAEITRRGSAYYMYLDRSDAGKAISFATNLGVNKCHVQIMDLGHMCDATMSYECPMLDEGVEPDDVDCWCNTTSTWVVYGTCHHKKGEARRSRRAVTLPSHSTRKLQTRSQTWLESREYTKHLIKVENWIFRNPGFALAAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIVNDIGHETDENRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQYAGTDGPCKVPAQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGVHQIFGAAFKSLFGGMSWFSQILIGTLLVWLGLNTKNGSISLTCLALGGVMIFLSTAVSADVGCSVDFSKRETRCGTGVFVYNDVEAWRDRYKYHPDSPRRLAAAVKQAWEEGICGISSVSRMENIMWKSVEGELNAILEENGVQLTVVVGSVKNPMWRGPQRLPVPVNELPHGWKAWGKSYFVRAAKTNNSFVVDGDTLKECPLKHRAWNSFLVEDHGFGVFHTSVWLKVREDYSLECDPAVIGTAVKGKEAAHSDLGYWIESEKNDTWRLKRAHLIEMKTCEWPKSHTLWTDGVEESDLIIPKSLAGPLSHHNTREGYRTQAKGPWHSEELEIRFEECPGTKVHVEETCGTRGPSLRSTTASGRVIEEWCCRECTMPPLSFRAKDGCWYGMEIRPRKEPESNLVRSMVTAGSTDHMDHFSLGVLVILLMVQEGLKKRMTTKIIMSTSMAVLVAMILGGFLMSDLAKLVILMGATFAEMNTGGDVAHLALVAAFKVRPALLVSFIFRANWTPRESMLLALASCLLQTAISALEGDLMVLVNGFALAWLAIRAMAVPRTDNIALAILAALTPLARGTLLVAWRAGLATCGGFMLLSLKGKGSVKKNLPFVMALGLTAVRIVDPINVVGLLLLTRSGKRSWPPSEVLTAVGLICALAGGFAKADIEMAGPMAAVGLLIVSYVVSGKSVDMYIERAGDITWEKDAEVTGNSPRLDVALDESGDFSLVEEDGPPMREIILKVVLMAICGMNPIAIPFAAGAWYVYVKTGKRSGALWDVPAPKEVKKGETTDGVYRVMTRRLLGSTQVGVGVMQEGVFHTMWHVTKGAALRSGEGRLDPYWGDVKQDLVSYCGPWKLDAAWDGLSEVQLLAVPPGERARNIQTLPGIFKTKDGDIGAVALDYPAGTSGSPILDKCGRVIGLYGNGVVIKNGSYVSAITQGKREEETPVECFEPSMLKKKQLTVLDLHPGAGKTRRVLPEIVREAIKKRLRTVILAPTRVVAAEMEEALRGLPVRYMTTAVNVTHSGTEIVDLMCHATFTSRLLQPIRVPNYNLYIMDEAHFTDPSSIAARGYISTRVEMGEAAAIFMTATPPGTRDAFPDSNSPIMDTEVEVPERAWSSGFDWVTDHSGKTVWFVPSVRNGNEIAACLTKAGKRVIQLSRKTFETEFQKTKNQEWDFVITTDISEMGANFKADRVIDSRRCLKPVILDGERVILAGPMPVTHASAAQRRGRIGRNPNKPGDEYMYGGGCAETDEDHAHWLEARMLLDNIYLQDGLIASLYRPEADKVAAIEGEFKLRTEQRKTFVELMKRGDLPVWLAYQVASAGITYTDRRWCFDGTTNNTIMEDSVPAEVWTKYGEKRVLKPRWMDARVCSDHAALKSFKEFAAGKRGVALGVMEALGTLPGHMTERFQEAIDNLAVLMRAETGSRPYKAAAAQLPETLETIMLLGLLGTVSLGIFFVLMRNKGIGKMGFGMVTLGASAWLMWLSEIEPARIACVLIVVFLLLVVLIPEPEKQRSPQDNQMAIIIMVAVGLLGLITANELGWLERTKNDIAHLMGRREEGVTMGFSMDIDLRPASAWAIYAALTTLITPAVQHAVTTSYNNYSLMAMATQAGVLFGMGKGMPFYAWDFGVPLLMMGCYSQLTPLTLIVAIILLVAHYMYLIPGLQAAAARAAQKRTAAGIMKNPVVDGIVVTDIDTMTIDPQVEKKMGQVLLIAVAISSAVLLRTAWGWGEAGALITAATSTLWEGSPNKYWNSSTATSLCNIFRGSYLAGASLIYTVTRNAGLVKRRGGGTGETLGEKWKARLNQMSALEFYSYKKSGITEVCREEARRALKDGVATGGHAVSRGSAKLRWLVERGYLQPHGKVVDLGCGRGGWSYYAATIRKVQEVKGYTKGGPGHEEPMLVQSYGWNIVRLKSGVDVFHMAAEPCDTLLCDIGESSSSPEVEETRTLRVLSMVGDWLEKRPGAFCIKVLCPYTSTMMETMERLQRRYGGGLVRVPLSRNSTHEMYWVSGAKSNVIKSVSTTSQLLLGRMDGPRRPVKYEEDVNLGSGTRAVASCAEAPNMKVIGKRIERIRSEHAETWFFDENHPYRTWAYHGSYEAPTQGSASSLVNGVVRLLSKPWDVVTGVTGIAMTDTTPYGQQRVFKEKVDTRVPDPQEGTRQAMNMVSSWLWKELGKRKRPRVCTKEEFINKVRSNAALGAIFEEEKEWKTAVEAVNDPRFWALVDKEREHHLRGECHSCVYNMMGKREKKQGEFGKAKGSRAIWYMWLGARFLEFEALGFLNEDHWMGRENSGGGVEGLGLQRLGYILEEMNRAPGGKMYADDTAGWDTRISKFDLENEALITNQMEEGHRALALAVIKYTKNKVVKVLRPAEGGKTVMDIISRQDQRGSGQVVTYALNTFTNLVVQLIRNMEAEEVLEMQDLWLLRKPEKVTRWLQCNGWDRLKRMAVSGDDCVVKPIDDRFAHALRFLNDMGKVRKDTQEWKPSTGWSNWEEVPFCSHHFNKLHLKDGRSIVVPCRHQDELIGRARVSPGAGWSIRETACLAKSYAQMWQLLYFHRRDLRLMANAICSAVPVDWVPTGRTTWSIHGKGEWMTTEDMLMVWNRVWIEENDHMEDKTPVTKWTDIPYLGKREDLWCGSLIGHRPRTTWAENIKDTVNMVRRIIGDEEKYMDYLSTQVRYLGEEGSTPGVL

SEQ ID NO: 105 - protein, 3417 aa, Zika virus
  Strain MR 766 polyprotein
MKNPKKKSGGFRIVNMLKRGVARVNPLGGLKRLPAGLLLGHGPIRMVLAILAFLRFTAIKPSLGLINRWGTVGKKEAMEIIKKFKKDLAAMLRIINARKERKRRGADTSIGIVGLLLTTAMAAEITRRGSAYYMYLDRSDAGKAISFATTLGVNKCHVQIMDLGHMCDATMSYECPMLDEGVEPDDVDCWCNTTSTWVVYGTCHHKKGEARRSRRAVTLPSHSTRKLQTRSQTWLESREYTKHLIKVENWIFRNPGFTLVAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIVNDENRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQYAGTDGPCKVPAQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSADVGCSVDFSKKETRCGTGVFVYNDVEAWRDRYKYHPDSPRRLAAAVKQAWEEGICGISSVSRMENIMWKSVEGELNAILEENGVQLTVVVGSVKNPMWRGPQRLPVPVNELPHGWKAWGKSYFVRAAKTNNSFVVDGDTLKECPLKHRAWNSFLVEDHGFGVFHTSVWLKVREDYSLECDPAVIGTAVKGKEAAHSDLGYWIESEKNDTWRLKRAHLIEMKTCEWPKSHTLWTDGVEESDLIIPKSLAGPLSHHNTREGYRTQVKGPWHSEELEIRFEECPGTKVHVEETCGTRGPSLRSTTASGRVIEEWCCRECTMPPLSFRAKDGCWYGMEIRPRKEPESNLVRSMVTAGSTDHMDHFSLGVLVILLMVQEGLKKRMTTKIIMSTSMAVLVAMILGGFSMSDLAKLVILMGATFAEMNTGGDVAHLALVAAFKVRPALLVSFIFRANWTPRESMLLALASCLLQTAISALEGDLMVLVNGFALAWLAIRAMAVPRTDNIALAILAALTPLARGTLLVAWRAGLATCGGFMLLSLKGKGSVKKNLPFVAALGLTAVRIVDPINVVGLLLLTRSGKRSWPPSEVLTAVGLICALAGGFAKADIEMAGPMAAVGLLIVSYVVSGKSVDMYIERAGDITWEKDAEVTGNSPRLDVALDESGDFSLVEEDGPPMREIILKVVLMAICGMNPIAIPFAAGAWYVYVKTGKRSGALWDVPAPKEVKKGETTDGVYRVMTRRLLGSTQVGVGVMQEGVFHTMWHVTKGAALRSGEGRLDPYWGDVKQDLVSYCGPWKLDAAWDGVSEVQLLAVPPGERARNIQTLPGIFKTKDGDIGAVALDYPAGTSGSPILDKCGRVIGLYGNGVVIKNGSYVSAITQGKREEETPVECFEPSMLKKKQLTVLDLHPGAGKTRRVLPEIVREAIKKRLRTVILAPTRVVAAEMEEALRGLPVRYMTTAVKVTHSGTEIVDLMCHATFTSRLLQPIRVPNYNLYIMDEAHFTDPSSIAARGYISTRVEMGEAAAIFMTATPPGTRDAFPDSNSPIMDTEVEVPERAWSSGFDWVTDHSGKTVWFVPSVRNGNEIAACLTKAGKRVIQLSRKTFETEFQKTKNQEWDFVITTDISEMGANFKADRVIDSRRCLKPVILDGERVILAGPMPVTHASAAQRRGRIGRNPNKPGDEYMYGGGCAETDEDHAHWLEARMLLDNIYLQDGLIASLYRPEADKVAAIEGEFKLRTEQRKTFVELMKRGDLPVWLAYQVASAGITYTDRRWCFDGTTNNTIMEDSVPAEVWTKYGEKRVLKPRWMDARVCSDHAALKSFKEFAAGKRGAALGVMEALGTLPGHMTERFQEAIDNLAVLMRAETGSRPYKAAAAQLPETLETIMLLGLLGTVSLGIFFVLMRNKGIGKMGFEMVTLGASAWLMWLSEIEPARIACVLIVVFLLLVVLIPEPEKQRSPQDNQMAIIIMVAVGLLGLITANELGWLERTKNDIAHLMGKREEGTTVGFSMDIDLRPASAWAIYAALTTLITPAVQHAVTTSYNNYSLMAMATQAGVLFGMGKGMPFYAWDLGVPLLMMGCYSQLTPLTLIVAIILLVAHYMYLIPGLQAAAARAAQKRTAAGIMKNPVVDGIVVTDIDTMTIDPQVEKKMGQVLLIAVAVSSAVLLRTAWGWGEAGALITAATSTLWEGSPNKYWNSSTATSLCNIFRGSYLAGASLIYTVTRNAGLVKRRGGGTGETLGEKWKARLNQMSALEFYSYKKSGITEVCREEARRALKDGVATGGHAVSRGSAKLRWLVERGYLQPYGKVVDLGCGRGGWSYYAATIRKVQEVRGYTKGGPGHEEPMLVQSYGWNIIRLKSGVDVFHMAAESCDTLLCDIGESSSSPEVEETRTLRVLSMVGDWLEKRPGAFCIKVLCPYTSTMMETMERLQRRYGGGLVRVPLSRNSTHEMYWVSGAKSNIIKSVSTTSQLLLGRMDGPRRPVKYEEDVNLGSGTRAVASCAEAPNMKVIGRRIERIRSEHAETWFFDENHPYRTWAYHGSYEAPTQGSASSLVNGVVRLLSKPWDVVTGVTGIAMTDTTPYGQQRVFKEKVDTRVPDPQEGTRQVMNMVASWLWKELGKRKRPRVCTKEEFINKVRSNAALGAIFEEEKEWKTAVEAVNDPRFWALVDKEREHHLRGECHSCVYNMMGKREKKQGEFGKAKGSRAIWYMWLGARFLEFEALGFLNEDHWMGRENSGGGVEGLGLQRLGYVLEEMSRAPGGKMYADDTAGWDTRISKFDLENEALITNQMDEGHRTLALAVIKYTYQNKVVKVLRPAEGGKTVMDIISRQDQRGSGQVVTYALNTFTNLVVQLIRNMEAEEVLEMQDLWLLRKPEKVTRWLQSSGWDRLKRMAVSGDDCVVKPIDDRFAHALRFLNDMGKVRKDTQEWKPSTGWSNWEEVPFCSHHFNKLHLKDGRSIVVPCRHQDELIGRARVSPGAGWSIRETACLAKSYAQMWQLLYFHRRDLRLMANAICSAVPVDWVPTGRTTWSIHGKGEWMTTEDMLMVWNRVWIEENDHMEDKTPVTKWTDIPYLGKREDLWCGSLIGHRPRTTWAENIKDTVSMVRRIIGDEEKYMDYLSTQVRYLGEEGSTPGVL

SEQ ID NO: 106 - protein, 3423 aa, Zika virus
  Isolate Brazil-ZKV2015
MKNPKKKSGGFRIVNMLKRGVARVSPFGGLKRLPAGLLLGHGPIRMVLAILAFLRFTAIKPSLGLINRWGSVGKKEAMEIIKKFKKDLAAMLRIINARKEKKRRGADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGTQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSADVGCSVDFSKKETRCGTGVFVYNDVEAWRDRYKYHPDSPRRLAAAVKQAWEDGICGISSVSRMENIMWRSVEGELNAILEENGVQLTVVVGSVKNPMWRGPQRLPVPVNELPHGWKAWGKSYFVRAAKTNNSFVVDGDTLKECPLKHRAWNSFLVEDHGFGVFHTSVWLKVREDYSLECDPAVIGTAVKGKEAVHSDLGYWIESEKNDTWRLKRAHLIEMKTCEWPKSHTLWTDGIEESDLIIPKSLAGPLSHHNTREGYRTQMKGPWHSEELEIRFEECPGTKVHVEETCGTRGPSLRSTTASGRVIEEWCCRECTMPPLSFRAKDGCWYGMEIRPRKEPESNLVRSMVTAGSTDHMDHFSLGVLVILLMVQEGLKKRMTTKIIISTSMAVLVAMILGGFSMSDLAKLAILMGATFAEMNTGGDVAHLALIAAFKVRPALLVSFIFRANWTPRESMLLALASCFLQTAISALEGDLMVLINGFALAWLAIRAMVVPRTDNITLAILAALTPLARGTLLVAWRAGLATCGGFMLLSLKGKGSVKKNLPFVMALGLTAVRLVDPINVVGLLLLTRSGKRSWPPSEVLTAVGLICALAGGFAKADIEMAGPMAAVGLLIVSYVVSGKSVDMYIERAGDITWEKDAEVTGNSPRLDVALDESGDFSLVEDDGPPMREIILKVVLMTICGMNPIAIPFAAGAWYVYVKTGKRSGALWDVPAPKEVKKGETTDGVYRVMTRRLLGSTQVGVGVMQEGVFHTMWHVTKGSALRSGEGRLDPYWGDVKQDLVSYCGPWKLDAAWDGHSEVQLLAVPPGERARNIQTLPGIFKTKDGDIGAVALDYPAGTSGSPILDKCGRVIGLYGNGVVIKNGSYVSAITQGRREEETPVECFEPSMLKKKQLTVLDLHPGAGKTRRVLPEIVREAIKTRLRTVILAPTRVVAAEMEEALRGLPVRYMTTAVNVTHSGTEIVDLMCHATFTSRLLQPIRVPNYNLYIMDEAHFTDPSSIAARGYISTRVEMGEAAAIFMTATPPGTRDAFPDSNSPIMDTEVEVPERAWSSGFDWVTDHSGKTVWFVPSVRNGNEIAACLTKAGKRVIQLSRKTFETEFQKTKHQEWDFVVTTDISEMGANFKADRVIDSRRCLKPVILDGERVILAGPMPVTHASAAQRRGRIGRNPNKPGDEYLYGGGCAETDEDHAHWLEARMLLDNIYLQDGLIASLYRPEADKVAAIEGEFKLRTEQRKTFVELMKRGDLPVWLAYQVASAGITYTDRRWCFDGTTNNTIMEDSVPAEVWTRHGEKRVLKPRWMDARVCSDHAALKSFKEFAAGKRGAAFGVMEALGTLPGHMTERFQEAIDNLAVLMRAETGSRPYKAAAAQLPETLETIMLLGLLGTVSLGIFFVLMRNKGIGKMGFGMVTLGASAWLMWLSEIEPARIACVLIVVFLLLVVLIPEPEKQRSPQDNQMAIIIMVAVGLLGLITANELGWLERTKSDLSHLMGRREEGATIGFSMDIDLRPASAWAIYAALTTFITPAVQHAVTTSYNNYSLMAMATQAGVLFGMGKGMPFYAWDFGVPLLMIGCYSQLTPLTLIVAIILLVAHYMYLIPGLQAAAARAAQKRTAAGIMKNPVVDGIVVTDIDTMTIDPQVEKKMGQVLLIAVAVSSAILSRTAWGWGEAGALITAATSTLWEGSPNKYWNSSTATSLCNIFRGSYLAGASLIYTVTRNAGLVKRRGGGTGETLGEKWKARLNQMSALEFYSYKKSGITEVCREEARRALKDGVATGGHAVSRGSAKLRWLVERGYLQPYGKVIDLGCGRGGWSYYAATIRKVQEVKGYTKGGPGHEEPVLVQSYGWNIVRLKSGVDVFHMAAEPCDTLLCDIGESSSSPEVEEARTLRVLSMVGDWLEKRPGAFCIKVLCPYTSTMMETLERLQRRYGGGLVRVPLSRNSTHEMYWVSGAKSNTIKSVSTTSQLLLGRMDGPRRPVKYEEDVNLGSGTRAVVSCAEAPNMKIIGNRIERIRSEHAETWFFDENHPYRTWAYHGSYVAPTQGSASSLINGVVRLLSKPWDVVTGVTGIAMTDTTPYGQQRVFKEKVDTRVPDPQEGTRQVMSMVSSWLWKELGKHKRPRVCTKEEFINKVRSNAALGAIFEEEKEWKTAVEAVNDPRFWALVDKEREHHLRGECQSCVYNMMGKREKKQGEFGKAKGSRAIWYMWLGARFLEFEALGFLNEDHWMGRENSGGGVEGLGLQRLGYVLEEMSRIPGGRMYADDTAGWDTRISRFDLENEALITNQMEKGHRALALAIIKYTYQNKVVKVLRPAEKGKTVMDIISRQDQRGSGQVVTYALNTFTNLVVQLIRNMEAEEVLEMQDLWLLRRSEKVTNWLQSNGWDRLKRMAVSGDDCVVKPIDDRFAHALRFLNDMGKVRKDTQEWKPSTGWDNWEEVPFCSHHFNKLHLKDGRSIVVPCRHQDELIGRARVSPGAGWSIRETACLAKSYAQMWQLLYFHRRDLRLMANAICSSVPVDWVPTGRTTWSIHGKGEWMTTEDMLVVWNRVWIEENDHMEDKTPVTKWTDIPYLGKREDLWCGSLIGHRPRTTWAENIKNTVNMVRRIIGDEEKYMDYLSTQVRYLGEEGSTPGVL

SEQ ID NO: 107 - protein, 3429 aa, Spondweni virus
  Strain SM-6 V-1 polyprotein
MKNPKRAGSSRLVNMLRRGAARVIPPGGGLKRLPVGLLLGRGPIKMILAILAFLRFTAIKPSTGLINRWGKVGKKEAIKILTKFKADVGTMLRIINNRKTKKRGVETGIVFLALLVSIVAVEVTKKGDTYYMFADKKDAGKVVTFETESGPNRCSIQAMDIGHMCPATMSYECPVLEPQYEPEDVDCWCNSTAAWIVYGTCTHKTTGETRRSRRSITLPSHASQKLETRSSTWLESREYSKYLIKVENWILRNPGYALVAAVIGWTLGSSRSQKIIFVTLLMLVAPAYSIRCIGIGNRDFIEGMSGGTWVDIVLEHGGCVTVMSNDKPTLDFELVTTTASNMAEVRSYCYEANISEMASDSRCPTQGEAYLDKMADSQFVCKRGYVDRGWGNGCGLFGKGSIVTCAKFTCVKKLTGKSIQPENLEYRVLVSVHASQHGGMINNDTNHQHDKENRARIDITASAPRVEVELGSFGSFSMECEPRSGLNFGDLYYLTMNNKHWLVNRDWFHDLSLPWHTGATSNNHHWNNKEALVEFREAHAKKQTAVVLGSQEGAVHAALAGALEAESDGHKATIYSGHLKCRLKLDKLRLKGMSYALCTGAFTFARTPSETIHGTATVELQYAGEDGPCKVPIVITSDTNSMASTGRLITANPVVTESGANSKMMVEIDPPFGDSYIIVGTGTTKITHHWHRAGSSIGRAFEATMRGAKRMAVLGDTAWDFGSVGGMFNSVGKFVHQVFGSAFKALFGGMSWFTQLLIGFLLIWMGLNARGGTVAMSFMGIGAMLIFLATSVSGDTGCSVDISRREMRCGSGIFVYNDVDAWRSRYKYHPETPRALAAAVKTAWEEGTCGITSVSRMENLMWSSVAGELNAILEDNSVPLTVVVGEPKYPLYNAPKRLKPPASELPQGWKSWGKSYFVSAAKNNNSFVVDGDTMKECPRQKRAWNSLRIEDHGFGVFHTSIWLKFHEDNSTECDTAIIGTAVRGKEAVHSDLGYWIESERNDTWRLSRAHLIEAKTCEWPRSHTLWTDGVEESELIIPRGLAGPFSHHNTRAGYKTQNKGPWHLGDVEIQFATCPGTTVVQDQECRDRGASLRTTTASGRVINEWCCRSCTMPPLSFKTKDGCWYAMEIRPVKEQESNLVRSHVTAGSTDHMDHFSLGLVVVMLMVQEGMKKRMTSKAIITSAAFLLAVMIVGGFTYQDFGRLVVLVGAAFAEMNTGGDVAHLALVAAFKVRPAMLVSFMFRALWTPRESLLLALAACLLQVSVTPLDHSIMIVVDGIALSWLCLKAILVPRTPNIALPLLAMLSPMLQGTTIVAWRAMMAALAVITLASMKHGRGVKKTFPYTIGCILGSMGLVENLGLVGLLLLTASKKRSWPPSEVMTAVGLICAIVGGLTKTDIDMAGPMAAIGLLVVSYVVSGKSVDMYIEKVCDISWDKDAEITGTSPRLDVALDDSGDFSLIQDDGPPTREIVLKVFLMCVCGVSPIAIPFAAAAWFVYIKSGKRSGAMWDIPSPREVKKGETTAGVYRIMTRKLLGSTQVGAGVMHEGVFHTMWHVTKGSALRSGEGRLDPYWGNVKQDLISYCGPWKLDGKWDGVSEVQLIAVAPGERARNVQTKPGVFKTTDGEIGALALDFPGGSSGSPIIDKNGHVIGLYGNGVVVKSGSYVSAIMQTEKMEEPAVDCFEEDMLRKKKLTVLDLHPGAGKTRRVLPQIVKAAIKKRLRTVILAPTRVVAAEMAEALKDLPIRYMTPAVSATHDGNEIVDLMCHATFTSRLMQPIRVPNYNLYIMDEAHFTDPASIAARGYIATRVDMGDAAAIFMTATPPGSTEAFPDSNAPITDVETEVPDKAWNSGFEWITDYPGKTVWFVPSVRMGNEISACLTKAGKSVIQLSRKTFETEYQKTKNGEWDFVVTTDISEMGANFKADRVIDSRKCLKPVILDDMEERVVLAGPMAVTPSSAAQRRGRIGRNPNKTGDEFYYGGGCAATDDDHAHWVEARMLLDNIYLQDNLVASLYKPEQGKVSAIEGEFKLRGEQRKTFVELMKRGDLPVWLSYQVAASGLSYTDRRWCFDGKNNNTILEDCVPVEVWTKFGEKKILKPRWMDARICSDHASLKSFKEFAAGKRTIATGLIEAFGMLPGHMTERFQEAVDNLAVLMRAEAGSRAHRMAAAQLPETMETILLLSLLAFVSLGVFFVLMRAKGLGKMGSGMIVLAGSGWLMWMSEVEPARIACVVIIVFLLMVVLIPEPEKQRSPQDNQLALIILIATGLITLIAANELGWLERTKSDLTRLFWREHAEPTGGRGFSFSLDIDLRPASAWAIYAAMTTLITPTVQHAVTTSYNNYSLMAMATQAGVLFGMGRGVPFYKWDFGVPLLMLGCYSQLTPLTLIVALVMLAAHYLYLIPGLQATAARAAQRRTAAGIMKNPVVDGIVVTDIDPIQIDPNVEKKMGQVMLIFVALASAVLMRTAWGWGEAGALASAAAATLWEGAPNKYWNSSTATSLCNIFRGSYLAGPSLIYTVTRNAGIMKKRGGGNGETVGEKWKERLNRMTALEFYAYKRSGITEVCREPARRALKDGVVTGGHAVSRGSAKLRWMVERGHVNLVGRVVDLGCGRGGWSYYAASQKQVLEVRGYTKGGAGHEEPMNVQSYGWNIVRLKSGVDVFYLPSEPCDTLLCDIGESSSSPAVEEARTLRVLGMVETWLERGVKNFCIKVLCPYTSAMIERLEALQRRYGGGLVRVPLSRNSTHEMYWVSGAKSNIIRSVNATSQLLMHRMDIPTRKTKFEEDVNLGTGTRAVESRADPPDMKKLGSRIERLRKEYGSTWHYDENHPYRTWHYHGSYEADTQGSASSMVNGVVRLLSKPWDALSSVTNIAMTDTTPFGQQRVFKEKVDTRTPDPKQGTQRVMAITSQWLWDRLARNKTPRMCTRQEFINKVNSHAALGPVFREQQGWGSAAEAVVDPRFWELVDNEREAHLRGECLTCVYNMMGKREKKLGEFGKAKGSRAIWYMWLGARFLEFEALGFLNEDHWLSRENSGGGVEGLGLQKLGYILEEISRRPGGKMYADDTAGWDTRITKCDLENEARILEKMDGIHKKLARAVIELTYKHKVVRVLRPAPQGKVVMDIISRPDQRGSGQVVTYALNTYTNLVVQLIRNMEAEAVINERDMEELQNPWKVINWLEGNGWDRLRSMAVSGDDCVVKPMDDRFAYALNFLNDMGKVRKDVQEWKPSPGWTNWEEVPFCSHHFNKLPMKDGRTIIVPCRHQDELIGRARVSPGKGWSLSETACLGKSYAQMWLLLYFHRRDLRLMANAICSAVPVSWVPTGRTTWSIHGRGEWMTTEDMLEVWNRVWIIENEYMEDKTPVTEWTDVPYLGKREDLWCGSLIGHRPRSTWAENIWAAIYQVRRAIGETEEYRDYMSTQVRYGSEEGPSAGVL

SEQ ID NO: 108 - protein, 3429 aa, Spondweni virus; identical to SEQ ID NO: 107
  NCBI Reference Sequence: NC_029055.1

SEQ ID NO: 109 - protein, 403 aa, Zika virus
  sE of SEQ ID NO:88
IRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNGTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRS

SEQ ID NO: 110 - protein, 403 aa, Zika virus; identical to SEQ ID NO: 27
  sE of SEQ ID NO:89

SEQ ID NO: 111 - protein, 403 aa, Zika virus; identical to SEQ ID NO: 27
  sE of SEQ ID NO:90

SEQ ID NO: 112 - protein, 403 aa, Zika virus
  sE of SEQ ID NO:91
IRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIVNDTGYETDENRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGKLFSGHLKCRLKMDKLRLKGVSYSLCTAAFTFTKVPAETLHGTVTVEVQYAGTDGPCKIPVQMAVDMQTLTPVGRLITANPVITESTENSKMMLELDPPFGDSYIVIGVGDKKITHHWHRS

SEQ ID NO: 113 - protein, 403 aa, Zika virus
  sE of SEQ ID NO:92
IRCIGVSNRDFVEGMSGGTWVDVVLEHGGCVTVMAQDKPTVDIELVTTTVSNMAEIRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRS

SEQ ID NO: 114 - protein, 403 aa, Zika virus; identical to SEQ ID NO: 113
  sE of SEQ ID NO:93

SEQ ID NO: 115 - protein, 403 aa, Zika virus
  sE of SEQ ID NO:94
IRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIVNDIGHETDENRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQYAGTDGPCKVPAQMAVDMQTLTPVGRLITANPVITESTENSKMMLELDPPFGDSYIVIGVGDKKITHHWHRS

SEQ ID NO: 116 - protein, 403 aa, Zika virus
  sE of SEQ ID NO:95
ISCIGVSNRDLVEGMSGGTWVDVVLEHGGCVTEMAQDKPTVDIELVTMTVSNMAEVRSYCYEASLSDMASASRCPTQGEPSLDKQSDTQSVCKRTLGDRGWGNGCGIFGKGSLVTCSKFTCCKKMPGKSIQPENLEYRIMLPVHGSQHSGMIVNDIGHETDENRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQSAGTDGPCKVPAQMAVDMQTLTPVGRLITANPVITESTENSKMMLELDPPFGDSYIVIGVGDKKITHHWHRS

SEQ ID NO: 117 - protein, 403 aa, Zika virus
  sE of SEQ ID NO:96
  misc_feature (152)..(156): Xaa can be any naturally occurring amino acid
IRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMXXXXXGHETDENRAKVEVTPNSPRAEATLGGFGSLGLDCEPRTGLDFSDLYYLTMNNKHRLVRKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQYAGTDGPCKVPAQMAVDMQTLTPVGRLITANPVITESTENSKMMLELDPPFGDSYIVIGVGDKKITHHWLKK

SEQ ID NO: 118 - protein, 403 aa, Zika virus
  sE of SEQ ID NO:97
IRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIVNDIGHETDENRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAVCTAAKVPAETLHGTVTVEVQYAGTDGPCKVPAQMAVDMQTLTPVGRLITANPVITESTENSKMMLELDPPFGDSYIVIGVGDKKITHHWHRS

SEQ ID NO: 119 - protein, 403 aa, Zika virus
  sE of SEQ ID NO:98
  misc_feature (156)..(162): Xaa can be any naturally occurring amino acid
IRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIVNDXXXXXXXNRAEVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQYAGTDGPCKVPAQMAVDMQTLTPVGRLITANPVITESTENSKMMLELDPPFGDSYIVIGVGDKKITHHWHRS

SEQ ID NO: 120 - protein, 403 aa, Zika virus
  sE of SEQ ID NO:99
IRCIGVSNRDFVEGMSGGTWVDVVLEHGGCVTVMAQDKPAVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRS

SEQ ID NO: 121 - protein, 403 aa, Zika virus; identical to SEQ ID NO: 27
  sE of SEQ ID NO:100

SEQ ID NO: 122 - protein, 403 aa, Zika virus
  sE of SEQ ID NO:101
IRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHTGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITEGTENSKMMLELDPPFGDSYIVIGVGEKKITHHWHRS

SEQ ID NO: 123 - protein, 403 aa, Zika virus; identical to SEQ ID NO: 115
  sE of SEQ ID NO:102

SEQ ID NO: 124 - protein, 397 aa, Zika virus
  sE of SEQ ID NO:103
IRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIVNDENRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQYAGTDGPCKVPAQMAVDMQTLTPVGRLITANPVITESTENSKMMLELDPPFGDSYIVIGVGDKKITHHWHRS

SEQ ID NO: 125 - protein, 403 aa, Zika virus; identical to SEQ ID NO: 115
  sE of SEQ ID NO:104

SEQ ID NO: 126 - protein, 397 aa, Zika virus; identical to SEQ ID NO: 124
  sE of SEQ ID NO:105

SEQ ID NO: 127 - protein, 403 aa, Zika virus
  sE of SEQ ID NO:106
IRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGTQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRS

SEQ ID NO: 128 - protein, 404 aa, Zika virus
  sE of SEQ ID NO:107
IRCIGIGNRDFIEGMSGGTWVDIVLEHGGCVTVMSNDKPTLDFELVTTTASNMAEVRSYCYEANISEMASDSRCPTQGEAYLDKMADSQFVCKRGYVDRGWGNGCGLFGKGSIVTCAKFTCVKKLTGKSIQPENLEYRVLVSVHASQHGGMINNDTNHQHDKENRARIDITASAPRVEVELGSFGSFSMECEPRSGLNFGDLYYLTMNNKHWLVNRDWFHDLSLPWHTGATSNNHHWNNKEALVEFREAHAKKQTAVVLGSQEGAVHAALAGALEAESDGHKATIYSGHLKCRLKLDKLRLKGMSYALCTGAFTFARTPSETIHGTATVELQYAGEDGPCKVPIVITSDTNSMASTGRLITANPVVTESGANSKMMVEIDPPFGDSYIIVGTGTTKITHHWHRA

SEQ ID NO: 129 - protein, 404 aa, Zika virus; identical to SEQ ID NO: 128
  sE of SEQ ID NO:108

SEQ ID NO: 130 - protein, 504 aa, Artificial sequence
  E-protein of SEQ ID NO:88 + stem anchor
IRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNGTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 131 - protein, 504 aa, Artificial sequence; identical to SEQ ID NO: 40
  E-protein of SEQ ID NO:89 + stem anchor

SEQ ID NO: 132 - protein, 504 aa, Artificial sequence; identical to SEQ ID NO: 40
  E-protein of SEQ ID NO:90 + stem anchor

SEQ ID NO: 133 - protein, 504 aa, Artificial sequence
  E-protein of SEQ ID NO:91 + stem anchor
IRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIVNDTGYETDENRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGKLFSGHLKCRLKMDKLRLKGVSYSLCTAAFTFTKVPAETLHGTVTVEVQYAGTDGPCKIPVQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSA

SEQ ID NO: 134 - protein, 504 aa, Artificial sequence
  E-protein of SEQ ID NO:92 + stem anchor
IRCIGVSNRDFVEGMSGGTWVDVVLEHGGCVTVMAQDKPTVDIELVTTTVSNMAEIRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 135 - protein, 504 aa, Artificial sequence; identical to SEQ ID NO: 134
  E-protein of SEQ ID NO:93 + stem anchor

SEQ ID NO: 136 - protein, 504 aa, Artificial sequence
  E-protein of SEQ ID NO:94 + stem anchor
IRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIVNDIGHETDENRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQYAGTDGPCKVPAQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSA

SEQ ID NO: 137 - protein, 504 aa, Artificial sequence
  E-protein of SEQ ID NO:95 + stem anchor
ISCIGVSNRDLVEGMSGGTWVDVVLEHGGCVTEMAQDKPTVDIELVTMTVSNMAEVRSYCYEASLSDMASASRCPTQGEPSLDKQSDTQSVCKRTLGDRGWGNGCGIFGKGSLVTCSKFTCCKKMPGKSIQPENLEYRIMLPVHGSQHSGMIVNDIGHETDENRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQSAGTDGPCKVPAQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSA

SEQ ID NO: 138 - protein, 504 aa, Artificial sequence
  E-protein of SEQ ID NO:96 + stem anchor
  misc_feature (152)..(156): Xaa can be any naturally occurring amino acid
IRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMXXXXXGHETDENRAKVEVTPNSPRAEATLGGFGSLGLDCEPRTGLDFSDLYYLTMNNKHRLVRKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQYAGTDGPCKVPAQMAVDMQTLTPVGRLITANPVITESTENSKMMLELDPPFGDSYIVIGVGDKKITHHWLKKGSSIGKAFEATVRGAKRMAVLGDTAWDFGSVGGVFNSLGKGVHQIFGAAFKSLFGGMSWFSQILIGTLLVWLGLNTKNGSISLTCLALGGVMIFLSTAVSA

SEQ ID NO: 139 - protein, 504 aa, Artificial sequence
  E-protein of SEQ ID NO:97 + stem anchor
IRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIVNDIGHETDENRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAVCTAAKVPAETLHGTVTVEVQYAGTDGPCKVPAQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSA

SEQ ID NO: 140 - protein, 504 aa, Artificial sequence
  E-protein of SEQ ID NO:98 + stem anchor
  misc_feature (156)..(162): Xaa can be any naturally occurring amino acid
IRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIVNDXXXXXXXNRAEVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQYAGTDGPCKVPAQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSA

SEQ ID NO: 141 - protein, 504 aa, Artificial sequence
  E-protein of SEQ ID NO:99 + stem anchor
IRCIGVSNRDFVEGMSGGTWVDVVLEHGGCVTVMAQDKPAVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLVWLGLNTKNGSISLTCLALGGVLIFLSTAVSA

SEQ ID NO: 142 - protein, 504 aa, Artificial sequence
  E-protein of SEQ ID NO:100 + stem anchor
IRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLVWLGLNTKNGSISLTCLALGGVLIFLSTAVSA

SEQ ID NO: 143 - protein, 504 aa, Artificial sequence
  E-protein of SEQ ID NO:101 + stem anchor
IRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHTGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITEGTENSKMMLELDPPFGDSYIVIGVGEKKITHHWHRSGSTIGKAFEATVRGAKRMAVLGDTAWDFGSVGGVLNSLGKGIHQIFGAAFKSLFGGMSWFSQILIGTLLMWLGLNTKNGSISLMCLALGGVLIFLSTAVSA

SEQ ID NO: 144 - protein, 504 aa, Artificial sequence
  E-protein of SEQ ID NO:102 + stem anchor
IRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIVNDIGHETDENRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQYAGTDGPCKVPAQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGVHQIFGAAFKSLFGGMSWFSQILIGTLLVWLGLNTKNGSISLTCLALGGVMIFLSTAVSA

SEQ ID NO: 145 - protein, 498 aa, Artificial sequence
  E-protein of SEQ ID NO:103 + stem anchor
IRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIVNDENRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQYAGTDGPCKVPAQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSA

SEQ ID NO: 146 - protein, 504 aa, Artificial sequence; identical to SEQ ID NO: 144
  E-protein of SEQ ID NO:104 + stem anchor

SEQ ID NO: 147 - protein, 498 aa, Artificial sequence; identical to SEQ ID NO: 145
  E-protein of SEQ ID NO:105 + stem anchor

SEQ ID NO: 148 - protein, 504 aa, Artificial sequence
  E-protein of SEQ ID NO:106 + stem anchor
IRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGTQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 149 - protein, 505 aa, Artificial sequence
  E-protein of SEQ ID NO:107 + stem anchor
IRCIGIGNRDFIEGMSGGTWVDIVLEHGGCVTVMSNDKPTLDFELVTTTASNMAEVRSYCYEANISEMASDSRCPTQGEAYLDKMADSQFVCKRGYVDRGWGNGCGLFGKGSIVTCAKFTCVKKLTGKSIQPENLEYRVLVSVHASQHGGMINNDTNHQHDKENRARIDITASAPRVEVELGSFGSFSMECEPRSGLNFGDLYYLTMNNKHWLVNRDWFHDLSLPWHTGATSNNHHWNNKEALVEFREAHAKKQTAVVLGSQEGAVHAALAGALEAESDGHKATIYSGHLKCRLKLDKLRLKGMSYALCTGAFTFARTPSETIHGTATVELQYAGEDGPCKVPIVITSDTNSMASTGRLITANPVVTESGANSKMMVEIDPPFGDSYIIVGTGTTKITHHWHRAGSSIGRAFEATMRGAKRMAVLGDTAWDFGSVGGMFNSVGKFVHQVFGSAFKALFGGMSWFTQLLIGFLLIWMGLNARGGTVAMSFMGIGAMLIFLATSVSG

SEQ ID NO: 150 - protein, 505 aa, Artificial sequence; identical to SEQ ID NO: 149
  E-protein of SEQ ID NO:108 + stem anchor

SEQ ID NO: 151 - protein, 589 aa, Artificial sequence
  SEQ ID NO 61 without N-terminal RR
GADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRS

SEQ ID NO: 152 - protein, 690 aa, Artificial sequence
  SEQ ID NO 62 without N-terminal RR
GADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGDFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 153 - DNA, 19800 bp, Artificial sequence
  pTM3 ATU3-GFP MV Schwarz sequence  + GFP within ATU3
tataagcggccgctaatacgactcactatagggccaactttgtttggtctgatgagtccgtgaggacgaaacccggagtcccgggtcaccaaacaaagttgggtaaggatagttcaatcaatgatcatcttctagtgcacttaggattcaagatcctattatcagggacaagagcaggattagggatatccgagatggccacacttttaaggagcttagcattgttcaaaagaaacaaggacaaaccacccattacatcaggatccggtggagccatcagaggaatcaaacacattattatagtaccaatccctggagattcctcaattaccactcgatccagacttctggaccggttggtgaggttaattggaaacccggatgtgagcgggcccaaactaacaggggcactaataggtatattatccttatttgtggagtctccaggtcaattgattcagaggatcaccgatgaccctgacgttagcataaggctgttagaggttgtccagagtgaccagtcacaatctggccttaccttcgcatcaagaggtaccaacatggaggatgaggcggaccaatacttttcacatgatgatccaattagtagtgatcaatccaggttcggatggttcgggaacaaggaaatctcagatattgaagtgcaagaccctgagggattcaacatgattctgggtaccatcctagcccaaatttgggtcttgctcgcaaaggcggttacggccccagacacggcagctgattcggagctaagaaggtggataaagtacacccaacaaagaagggtagttggtgaatttagattggagagaaaatggttggatgtggtgaggaacaggattgccgaggacctctccttacgccgattcatggtcgctctaatcctggatatcaagagaacacccggaaacaaacccaggattgctgaaatgatatgtgacattgatacatatatcgtagaggcaggattagccagttttatcctgactattaagtttgggatagaaactatgtatcctgctcttggactgcatgaatttgctggtgagttatccacacttgagtccttgatgaacctttaccagcaaatgggggaaactgcaccctacatggtaatcctggagaactcaattcagaacaagttcagtgcaggatcataccctctgctctggagctatgccatgggagtaggagtggaacttgaaaactccatgggaggtttgaactttggccgatcttactttgatccagcatattttagattagggcaagagatggtaaggaggtcagctggaaaggtcagttccacattggcatctgaactcggtatcactgccgaggatgcaaggcttgtttcagagattgcaatgcatactactgaggacaagatcagtagagcggttggacccagacaagcccaagtatcatttctacacggtgatcaaagtgagaatgagctaccgagattggggggcaaggaagataggagggtcaaacagagtcgaggagaagccagggagagctacagagaaaccgggcccagcagagcaagtgatgcgagagctgcccatcttccaaccggcacacccctagacattgacactgcaacggagtccagccaagatccgcaggacagtcgaaggtcagctgacgccctgcttaggctgcaagccatggcaggaatctcggaagaacaaggctcagacacggacacccctatagtgtacaatgacagaaatcttctagactaggtgcgagaggccgagggccagaacaacatccgcctaccatccatcattgttataaaaaacttaggaaccaggtccacacagccgccagcccatcaaccatccactcccacgattggagccaatggcagaagagcaggcacgccatgtcaaaaacggactggaatgcatccgggctctcaaggccgagcccatcggctcactggccatcgaggaagctatggcagcatggtcagaaatatcagacaacccaggacaggagcgagccacctgcagggaagagaaggcaggcagttcgggtctcagcaaaccatgcctctcagcaattggatcaactgaaggcggtgcacctcgcatccgcggtcagggacctggagagagcgatgacgacgctgaaactttgggaatccccccaagaaatctccaggcatcaagcactgggttacagtgttattacgtttatgatcacagcggtgaagcggttaagggaatccaagatgctgactctatcatggttcaatcaggccttgatggtgatagcaccctctcaggaggagacaatgaatctgaaaacagcgatgtggatattggcgaacctgataccgagggatatgctatcactgaccggggatctgctcccatctctatggggttcagggcttctgatgttgaaactgcagaaggaggggagatccacgagctcctgagactccaatccagaggcaacaactttccgaagcttgggaaaactctcaatgttcctccgcccccggaccccggtagggccagcacttccgggacacccattaaaaagggcacagacgcgagattagcctcatttggaacggagatcgcgtctttattgacaggtggtgcaacccaatgtgctcgaaagtcaccctcggaaccatcagggccaggtgcacctgcggggaatgtccccgagtgtgtgagcaatgccgcactgatacaggagtggacacccgaatctggtaccacaatctccccgagatcccagaataatgaagaagggggagactattatgatgatgagctgttctctgatgtccaagatattaaaacagccttggccaaaatacacgaggataatcagaagataatctccaagctagaatcactgctgttattgaagggagaagttgagtcaattaagaagcagatcaacaggcaaaatatcagcatatccaccctggaaggacacctctcaagcatcatgatcgccattcctggacttgggaaggatcccaacgaccccactgcagatgtcgaaatcaatcccgacttgaaacccatcataggcagagattcaggccgagcactggccgaagttctcaagaaacccgttgccagccgacaactccaaggaatgacaaatggacggaccagttccagaggacagctgctgaaggaatttcagctaaagccgatcgggaaaaagatgagctcagccgtcgggtttgttcctgacaccggccctgcatcacgcagtgtaatccgctccattataaaatccagccggctagaggaggatcggaagcgttacctgatgactctccttgatgatatcaaaggagccaatgatcttgccaagttccaccagatgctgatgaagataataatgaagtagctacagctcaacttacctgccaaccccatgccagtcgacccaactagtacaacctaaatccattataaaaaacttaggagcaaagtgattgcctcccaaggtccacaatgacagagacctacgacttcgacaagtcggcatgggacatcaaagggtcgatcgctccgatacaacccaccacctacagtgatggcaggctggtgccccaggtcagagtcatagatcctggtctaggcgacaggaaggatgaatgctttatgtacatgtttctgctgggggttgttgaggacagcgattccctagggcctccaatcgggcgagcatttgggttcctgcccttaggtgttggcagatccacagcaaagcccgaaaaactcctcaaagaggccactgagcttgacatagttgttagacgtacagcagggctcaatgaaaaactggtgttctacaacaacaccccactaactctcctcacaccttggagaaaggtcctaacaacagggagtgtcttcaacgcaaaccaagtgtgcaatgcggttaatctgataccgctcgataccccgcagaggttccgtgttgtttatatgagcatcacccgtctttcggataacgggtattacaccgttcctagaagaatgctggaattcagatcggtcaatgcagtggccttcaacctgctggtgacccttaggattgacaaggcgataggccctgggaagatcatcgacaatacagagcaacttcctgaggcaacatttatggtccacatcgggaacttcaggagaaagaagagtgaagtctactctgccgattattgcaaaatgaaaatcgaaaagatgggcctggtttttgcacttggtgggatagggggcaccagtcttcacattagaagcacaggcaaaatgagcaagactctccatgcacaactcgggttcaagaagaccttatgttacccgctgatggatatcaatgaagaccttaatcgattactctggaggagcagatgcaagatagtaagaatccaggcagttttgcagccatcagttcctcaagaattccgcatttacgacgacgtgatcataaatgatgaccaaggactattcaaagttctgtagaccgtagtgcccagcaatgcccgaaaacgacccccctcacaatgacagccagaaggcccggacaaaaaagccccctccgaaagactccacggaccaagcgagaggccagccagcagccgacggcaagcgcgaacaccaggcggccccagcacagaacagccctgacacaaggccaccaccagccaccccaatctgcatcctcctcgtgggacccccgaggaccaacccccaaggctgcccccgatccaaaccaccaaccgcatccccaccacccccgggaaagaaacccccagcaattggaaggcccctccccctcttcctcaacacaagaactccacaaccgaaccgcacaagcgaccgaggtgacccaaccgcaggcatccgactccctagacagatcctctctccccggcaaactaaacaaaacttagggccaaggaacatacacacccaacagaacccagaccccggcccacggcgccgcgcccccaacccccgacaaccagagggagcccccaaccaatcccgccggctcccccggtgcccacaggcagggacaccaacccccgaacagacccagcacccaaccatcgacaatccaagacgggggggcccccccaaaaaaaggcccccaggggccgacagccagcaccgcgaggaagcccacccaccccacacacgaccacggcaaccaaaccagaacccagaccaccctgggccaccagctcccagactcggccatcaccccgcagaaaggaaaggccacaacccgcgcaccccagccccgatccggcggggagccacccaacccgaaccagcacccaagagcgatccccgaaggacccccgaaccgcaaaggacatcagtatcccacagcctctccaagtcccccggtctcctcctcttctcgaagggaccaaaagatcaatccaccacacccgacgacactcaactccccacccctaaaggagacaccgggaatcccagaatcaagactcatccaatgtccatcatgggtctcaaggtgaacgtctctgccatattcatggcagtactgttaactctccaaacacccaccggtcaaatccattggggcaatctctctaagataggggtggtaggaataggaagtgcaagctacaaagttatgactcgttccagccatcaatcattagtcataaaattaatgcccaatataactctcctcaataactgcacgagggtagagattgcagaatacaggagactactgagaacagttttggaaccaattagagatgcacttaatgcaatgacccagaatataagaccggttcagagtgtagcttcaagtaggagacacaagagatttgcgggagtagtcctggcaggtgcggccctaggcgttgccacagctgctcagataacagccggcattgcacttcaccagtccatgctgaactctcaagccatcgacaatctgagagcgagcctggaaactactaatcaggcaattgagacaatcagacaagcagggcaggagatgatattggctgttcagggtgtccaagactacatcaataatgagctgataccgtctatgaaccaactatcttgtgatttaatcggccagaagctcgggctcaaattgctcagatactatacagaaatcctgtcattatttggccccagtttacgggaccccatatctgcggagatatctatccaggctttgagctatgcgcttggaggagacatcaataaggtgttagaaaagctcggatacagtggaggtgatttactgggcatcttagagagcggaggaataaaggcccggataactcacgtcgacacagagtcctacttcattgtcctcagtatagcctatccgacgctgtccgagattaagggggtgattgtccaccggctagagggggtctcgtacaacataggctctcaagagtggtataccactgtgcccaagtatgttgcaacccaagggtaccttatctcgaattttgatgagtcatcgtgtactttcatgccagaggggactgtgtgcagccaaaatgccttgtacccgatgagtcctctgctccaagaatgcctccgggggtacaccaagtcctgtgctcgtacactcgtatccgggtcttttgggaaccggttcattttatcacaagggaacctaatagccaattgtgcatcaatcctttgcaagtgttacacaacaggaacgatcattaatcaagaccctgacaagatcctaacatacattgctgccgatcactgcccggtagtcgaggtgaacggcgtgaccatccaagtcgggagcaggaggtatccagacgctgtgtacttgcacagaattgacctcggtcctcccatatcattggagaggttggacgtagggacaaatctggggaatgcaattgctaagttggaggatgccaaggaattgttggagtcatcggaccagatattgaggagtatgaaaggtttatcgagcactagcatagtctacatcctgattgcagtgtgtcttggagggttgatagggatccccgctttaatatgttgctgcagggggcgttgtaacaaaaagggagaacaagttggtatgtcaagaccaggcctaaagcctgatcttacgggaacatcaaaatcctatgtaaggtcgctctgatcctctacaactcttgaaacacaaatgtcccacaagtctcctcttcgtcatcaagcaaccaccgcacccagcatcaagcccacctgaaattatctccggcttccctctggccgaacaatatcggtagttaatcaaaacttagggtgcaagatcatccacaatgtcaccacaacgagaccggataaatgccttctacaaagataacccccatcccaagggaagtaggatagtcattaacagagaacatcttatgattgatagaccttatgttttgctggctgttctgtttgtcatgtttctgagcttgatcgggttgctagccattgcaggcattagacttcatcgggcagccatctacaccgcagagatccataaaagcctcagcaccaatctagatgtaactaactcaatcgagcatcaggtcaaggacgtgctgacaccactcttcaaaatcatcggtgatgaagtgggcctgaggacacctcagagattcactgacctagtgaaattaatctctgacaagattaaattccttaatccggatagggagtacgacttcagagatctcacttggtgtatcaacccgccagagagaatcaaattggattatgatcaatactgtgcagatgtggctgctgaagagctcatgaatgcattggtgaactcaactctactggagaccagaacaaccaatcagttcctagctgtctcaaagggaaactgctcagggcccactacaatcagaggtcaattctcaaacatgtcgctgtccctgttagacttgtatttaggtcgaggttacaatgtgtcatctatagtcactatgacatcccagggaatgtatgggggaacttacctagtggaaaagcctaatctgagcagcaaaaggtcagagttgtcacaactgagcatgtaccgagtgtttgaagtaggtgttatcagaaatccgggtttgggggctccggtgttccatatgacaaactatcttgagcaaccagtcagtaatgatctcagcaactgtatggtggctttgggggagctcaaactcgcagccctttgtcacggggaagattctatcacaattccctatcagggatcagggaaaggtgtcagcttccagctcgtcaagctaggtgtctggaaatccccaaccgacatgcaatcctgggtccccttatcaacggatgatccagtgatagacaggctttacctctcatctcacagaggtgttatcgctgacaatcaagcaaaatgggctgtcccgacaacacgaacagatgacaagttgcgaatggagacatgcttccaacaggcgtgtaagggtaaaatccaagcactctgcgagaatcccgagtgggcaccattgaaggataacaggattccttcatacggggtcttgtctgttgatctgagtctgacagttgagcttaaaatcaaaattgcttcgggattcgggccattgatcacacacggttcagggatggacctatacaaatccaaccacaacaatgtgtattggctgactatcccgccaatgaagaacctagccttaggtgtaatcaacacattggagtggataccgagattcaaggttagtccctacctcttcactgtcccaattaaggaagcaggcgaagactgccatgccccaacatacctacctgcggaggtggatggtgatgtcaaactcagttccaatctggtgattctacctggtcaagatctccaatatgttttggcaacctacgatacttccagggttgaacatgctgtggtttattacgtttacagcccaagccgctcattttcttacttttatccttttaggttgcctataaagggggtccccatcgaattacaagtggaatgcttcacatgggaccaaaaactctggtgccgtcacttctgtgtgcttgcggactcagaatctggtggacatatcactcactctgggatggtgggcatgggagtcagctgcacagtcacccgggaagatggaaccaatcgcagatagggctgctagtgaaccaatcacatgatgtcacccagacatcaggcatacccactagtctaccctccatcattgttataaaaaacttaggaaccaggtccacacagccgccagcccatcaacgcgtacgatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaggcgcgcagcgcttagacgtctcgcgatcgatgctagtgtgaaatagacatcagaattaagaaaaacgtagggtccaagtggttccccgttatggactcgctatctgtcaaccagatcttataccctgaagttcacctagatagcccgatagttaccaataagatagtagccatcctggagtatgctcgagtccctcacgcttacagcctggaggaccctacactgtgtcagaacatcaagcaccgcctaaaaaacggattttccaaccaaatgattataaacaatgtggaagttgggaatgtcatcaagtccaagcttaggagttatccggcccactctcatattccatatccaaattgtaatcaggatttatttaacatagaagacaaagagtcaacgaggaagatccgtgaactcctcaaaaaggggaattcgctgtactccaaagtcagtgataaggttttccaatgcttaagggacactaactcacggcttggcctaggctccgaattgagggaggacatcaaggagaaagttattaacttgggagtttacatgcacagctcccagtggtttgagccctttctgttttggtttacagtcaagactgagatgaggtcagtgattaaatcacaaacccatacttgccataggaggagacacacacctgtattcttcactggtagttcagttgagttgctaatctctcgtgaccttgttgctataatcagtaaagagtctcaacatgtatattacctgacatttgaactggttttgatgtattgtgatgtcatagaggggaggttaatgacagagaccgctatgactattgatgctaggtatacagagcttctaggaagagtcagatacatgtggaaactgatagatggtttcttccctgcactcgggaatccaacttatcaaattgtagccatgctggagcctctttcacttgcttacctgcagctgagggatataacagtagaactcagaggtgctttccttaaccactgctttactgaaatacatgatgttcttgaccaaaacgggttttctgatgaaggtacttatcatgagttaactgaagctctagattacattttcataactgatgacatacatctgacaggggagattttctcatttttcagaagtttcggccaccccagacttgaagcagtaacggctgctgaaaatgttaggaaatacatgaatcagcctaaagtcattgtgtatgagactctgatgaaaggtcatgccatattttgtggaatcataatcaacggctatcgtgacaggcacggaggcagttggccaccgctgaccctccccctgcatgctgcagacacaatccggaatgctcaagcttcaggtgaagggttaacacatgagcagtgcgttgataactggaaatcttttgctggagtgaaatttggctgctttatgcctcttagcctggatagtgatctgacaatgtacctaaaggacaaggcacttgctgctctccaaagggaatgggattcagtttacccgaaagagttcctgcgttacgaccctcccaagggaaccgggtcacggaggcttgtagatgttttccttaatgattcgagctttgacccatatgatgtgataatgtatgttgtaagtggagcttacctccatgaccctgagttcaacctgtcttacagcctgaaagaaaaggagatcaaggaaacaggtagactttttgctaaaatgacttacaaaatgagggcatgccaagtgattgctgaaaatctaatctcaaacgggattggcaaatattttaaggacaatgggatggccaaggatgagcacgatttgactaaggcactccacactctagctgtctcaggagtccccaaagatctcaaagaaagtcacaggggggggccagtcttaaaaacctactcccgaagcccagtccacacaagtaccaggaacgtgagagcagcaaaagggtttatagggttccctcaagtaattcggcaggaccaagacactgatcatccggagaatatggaagcttacgagacagtcagtgcatttatcacgactgatctcaagaagtactgccttaattggagatatgagaccatcagcttgtttgcacagaggctaaatgagatttacggattgccctcatttttccagtggctgcataagaggcttgagacctctgtcctgtatgtaagtgaccctcattgcccccccgaccttgacgcccatatcccgttatataaagtccccaatgatcaaatcttcattaagtaccctatgggaggtatagaagggtattgtcagaagctgtggaccatcagcaccattccctatctatacctggctgcttatgagagcggagtaaggattgcttcgttagtgcaaggggacaatcagaccatagccgtaacaaaaagggtacccagcacatggccctacaaccttaagaaacgggaagctgctagagtaactagagattactttgtaattcttaggcaaaggctacatgatattggccatcacctcaaggcaaatgagacaattgtttcatcacatttttttgtctattcaaaaggaatatattatgatgggctacttgtgtcccaatcactcaagagcatcgcaagatgtgtattctggtcagagactatagttgatgaaacaagggcagcatgcagtaatattgctacaacaatggctaaaagcatcgagagaggttatgaccgttaccttgcatattccctgaacgtcctaaaagtgatacagcaaattctgatctctcttggcttcacaatcaattcaaccatgacccgggatgtagtcatacccctcctcacaaacaacgacctcttaataaggatggcactgttgcccgctcctattggggggatgaattatctgaatatgagcaggctgtttgtcagaaacatcggtgatccagtaacatcatcaattgctgatctcaagagaatgattctcgcctcactaatgcctgaagagaccctccatcaagtaatgacacaacaaccgggggactcttcattcctagactgggctagcgacccttactcagcaaatcttgtatgtgtccagagcatcactagactcctcaagaacataactgcaaggtttgtcctgatccatagtccaaacccaatgttaaaaggattattccatgatgacagtaaagaagaggacgagggactggcggcattcctcatggacaggcatattatagtacctagggcagctcatgaaatcctggatcatagtgtcacaggggcaagagagtctattgcaggcatgctggataccacaaaaggcttgattcgagccagcatgaggaagggggggttaacctctcgagtgataaccagattgtccaattatgactatgaacaattcagagcagggatggtgctattgacaggaagaaagagaaatgtcctcattgacaaagagtcatgttcagtgcagctggcgagagctctaagaagccatatgtgggcgaggctagctcgaggacggcctatttacggccttgaggtccctgatgtactagaatctatgcgaggccaccttattcggcgtcatgagacatgtgtcatctgcgagtgtggatcagtcaactacggatggttttttgtcccctcgggttgccaactggatgatattgacaaggaaacatcatccttgagagtcccatatattggttctaccactgatgagagaacagacatgaagcttgccttcgtaagagccccaagtcgatccttgcgatctgctgttagaatagcaacagtgtactcatgggcttacggtgatgatgatagctcttggaacgaagcctggttgttggctaggcaaagggccaatgtgagcctggaggagctaagggtgatcactcccatctcaacttcgactaatttagcgcataggttgagggatcgtagcactcaagtgaaatactcaggtacatcccttgtccgagtggcgaggtataccacaatctccaacgacaatctctcatttgtcatatcagataagaaggttgatactaactttatataccaacaaggaatgcttctagggttgggtgttttagaaacattgtttcgactcgagaaagataccggatcatctaacacggtattacatcttcacgtcgaaacagattgttgcgtgatcccgatgatagatcatcccaggatacccagctcccgcaagctagagctgagggcagagctatgtaccaacccattgatatatgataatgcacctttaattgacagagatgcaacaaggctatacacccagagccataggaggcaccttgtggaatttgttacatggtccacaccccaactatatcacattttagctaagtccacagcactatctatgattgacctggtaacaaaatttgagaaggaccatatgaatgaaatttcagctctcataggggatgacgatatcaatagtttcataactgagtttctgctcatagagccaagattattcactatctacttgggccagtgtgcggccatcaattgggcatttgatgtacattatcatagaccatcagggaaatatcagatgggtgagctgttgtcatcgttcctttctagaatgagcaaaggagtgtttaaggtgcttgtcaatgctctaagccacccaaagatctacaagaaattctggcattgtggtattatagagcctatccatggtccttcacttgatgctcaaaacttgcacacaactgtgtgcaacatggtttacacatgctatatgacctacctcgacctgttgttgaatgaagagttagaagagttcacatttctcttgtgtgaaagcgacgaggatgtagtaccggacagattcgacaacatccaggcaaaacacttatgtgttctggcagatttgtactgtcaaccagggacctgcccaccaattcgaggtctaagaccggtagagaaatgtgcagttctaaccgaccatatcaaggcagaggctatgttatctccagcaggatcttcgtggaacataaatccaattattgtagaccattactcatgctctctgacttatctccggcgaggatcgatcaaacagataagattgagagttgatccaggattcattttcgacgccctcgctgaggtaaatgtcagtcagccaaagatcggcagcaacaacatctcaaatatgagcatcaaggctttcagacccccacacgatgatgttgcaaaattgctcaaagatatcaacacaagcaagcacaatcttcccatttcagggggcaatctcgccaattatgaaatccatgctttccgcagaatcgggttgaactcatctgcttgctacaaagctgttgagatatcaacattaattaggagatgccttgagccaggggaggacggcttgttcttgggtgagggatcgggttctatgttgatcacttataaagagatacttaaactaaacaagtgcttctataatagtggggtttccgccaattctagatctggtcaaagggaattagcaccctatccctccgaagttggccttgtcgaacacagaatgggagtaggtaatattgtcaaagtgctctttaacgggaggcccgaagtcacgtgggtaggcagtgtagattgcttcaatttcatagttagtaatatccctacctctagtgtggggtttatccattcagatatagagaccttgcctgacaaagatactatagagaagctagaggaattggcagccatcttatcgatggctctgctcctgggcaaaataggatcaatactggtgattaagcttatgcctttcagcggggattttgttcagggatttataagttatgtagggtctcattatagagaagtgaaccttgtataccctagatacagcaacttcatctctactgaatcttatttggttatgacagatctcaaggctaaccggctaatgaatcctgaaaagattaagcagcagataattgaatcatctgtgaggacttcacctggacttataggtcacatcctatccattaagcaactaagctgcatacaagcaattgtgggagacgcagttagtagaggtgatatcaatcctactctgaaaaaacttacacctatagagcaggtgctgatcaattgcgggttggcaattaacggacctaagctgtgcaaagaattgatccaccatgatgttgcctcagggcaagatggattgcttaattctatactcatcctctacagggagttggcaagattcaaagacaaccaaagaagtcaacaagggatgttccacgcttaccccgtattggtaagtagcaggcaacgagaacttatatctaggatcacccgcaaattctgggggcacattcttctttactccgggaacaaaaagttgataaataagtttatccagaatctcaagtccggctatctgatactagacttacaccagaatatcttcgttaagaatctatccaagtcagagaaacagattattatgacggggggtttgaaacgtgagtgggtttttaaggtaacagtcaaggagaccaaagaatggtataagttagtcggatacagtgccctgattaaggactaattggttgaactccggaaccctaatcctgccctaggtggttaggcattatttgcaatatattaaagaaaactttgaaaatacgaagtttctattcccagctttgtctggtggccggcatggtcccagcctcctcgctggcgccggctgggcaacattccgaggggaccgtcccctcggtaatggcgaatgggacgcggccgatccggctgctaacaaagcccgaaaggaagctgagttggctgctgccaccgctgagcaataactagcataaccccttggggcctctaaacgggtcttgaggggttttttgctgaaaggaggaactatatccggatgcggccgcgggccctatggtacccagcttttgttccctttagtgagggttaattccgagcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctcggcccccctgacgagcatcacaaaaatcgacgctcaagtcagaggtggcgaaacccgacaggactataaagataccaggcgttcccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactgcccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgaaaaaaagcggttagctccttcggtcctccgatcgttgtcagaagtaagttggccgcagtgttatcactcatgcttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagccaccgcggtg

SEQ ID NO: 154 - DNA, 10 bp, Artificial sequence
  Kozak sequence
gccaccatgg

SEQ ID NO: 155 - DNA, 12 bp, Artificial sequence
  Kozak sequence + alanine after start codon
gccaccatggca

SEQ ID NO: 156 - DNA, 63 bp, Artificial sequence
  Enhanced honeybee melittin signal peptide
atgaaattcttagtcaacgttgcccttgtttttatggtcgtatacatttcttacatctatgcg

SEQ ID NO: 157 - protein, 19 aa, Homo sapiens
  Azurocidin signal peptide
MTRLTVLALLAGLLASSRA

SEQ ID NO: 158 - protein, 18 aa, Homo sapiens
  Serum albumin signal peptide
MKWVTFISLLFLFSSAYS

SEQ ID NO: 159 - protein, 23 aa, Homo sapiens
  Leukocyte immunoglobulin-like receptor subfamily B member 1 signal peptide
MTPILTVLICLGLSLGPRTHVQA

SEQ ID NO: 160 - protein, 30 aa, Bos taurus
  Prolactin signal peptide
MDSKGSSQKGSRLLLLLVVSNLLLCQGVVS

SEQ ID NO: 161 - protein, 58 aa, Lymphocytic choriomeningitis virus
  Strain Armstrong, pre-glycoprotein polyprotein GP complex signal peptide
MGQIVTMFEALPHIIDEVINIVIIVLIVITGIKAVYNFATCGIFALISFLLLAGRSCG

SEQ ID NO: 162 - protein, 27 aa, Homo sapiens
  Insulin receptor signal peptide
MATGGRRGAAAAPLLVAVAALLLGAAG

SEQ ID NO: 163 - protein, 20 aa, Drosophila melanogaster
  BM-40 signal peptide
MRSLWLLLGLGLLAVSHVQA

SEQ ID NO: 164 - protein, 16 aa, Vesicular stomatitis virus
  Glycoprotein protein signal peptide
MKCLLYLAFLFIGVNC

SEQ ID NO: 165 - protein, 18 aa, Homo sapiens
  Chymotrypsinogen B signal peptide
MASLWLLSCFSLVGAAFG

SEQ ID NO: 166 - protein, 20 aa, Homo sapiens
  Interleukin-2 signal peptide
MYRMQLLSCIALSLALVTNS

SEQ ID NO: 167 - protein, 17 aa, Gaussia princeps
  Luciferase signal peptide
MGVKVLFALICIAVAEA

SEQ ID NO: 168 - protein, 19 aa, Gaussia princeps
  Gluc Luciferase signal peptide
MGVKVLFALICIAVAEVTG

SEQ ID NO: 169 - protein, 17 aa, Influenza A virus
  Strain A/Puerto Rico/8/1934 H1N1 Hemagglutinin (HA) signal peptide
MKANLLVLLCALAAADA

SEQ ID NO: 170 - protein, 15 aa, Influenza A virus
  Strain A/Japan/305/1957 H2N2 Hemagglutinin (HA) signal peptide
MAIIYLILLFTAVRG

SEQ ID NO: 171 - protein, 16 aa, Influenza A virus
  Strain A/Hong Kong/156/1997 H5N1 genotype Gs/Gd Hemagglutinin signal peptide
MEKTVLLLATVSLVKS

SEQ ID NO: 172 - protein, 21 aa, Hepatitis C Virus
  HCV 1b E1 signal peptide
MGCSFSIFLLALLSCLTTPAS

SEQ ID NO: 173 - protein, 20 aa, Hepatitis C Virus
  1b E2 signal peptide
MVGNWAKVLIVMLLFAGVDG

SEQ ID NO: 174 - protein, 19 aa, Artificial sequence
  Signal peptide based on HCV 1b
MDAMKVLLLVFVSPSQVTG

SEQ ID NO: 175 - protein, 22 aa, Homo sapiens
  Tissue-type plasminogen activator signal peptide 1
MDAMKRGLCCVLLLCGAVFVSP

SEQ ID NO: 176 - protein, 25 aa, Homo sapiens
  Tissue-type plasminogen activator signal peptide 2
MDAMKRGLCCVLLLCGAVFVDSVTG

SEQ ID NO: 177 - protein, 26 aa, Murray Valley encephalitis virus
  MVE prM signal peptide
KKRGGSETSVLMLIFMLIGFAAALKL

SEQ ID NO: 178 - protein, 26 aa, Yellow fever virus
  Signal peptide
KRRSHDVLTVQFLILGMLLMTGGVTL

SEQ ID NO: 179 - protein, 24 aa, Kunjin virus
  Signal peptide
KKRGGKTGIAFMIGLIAGVGAVTL

SEQ ID NO: 180 - protein, 26 aa, Tick-borne encephalitis virus
  Signal peptide
KRRSATDWMSWLLVITLLGMTLAATV

SEQ ID NO: 181 - protein, 20 aa, Dengue virus
  Signal peptide
RRRTAGMIIMLIPTVMAFHL

SEQ ID NO: 182 - protein, 24 aa, West Nile virus
  Signal peptide
KKRGGTAGFTILLGLIACAGAVTL

SEQ ID NO: 183 - protein, 28 aa, Japanese encephalitis virus
  Signal peptide 1
NKRGGNEGSIMWLASLAVVIAYAGAMKL

SEQ ID NO: 184 - protein, 24 aa, Japanese encephalitis virus
  SA-14 JE isolate (GenBank accession # M55506) signal peptide 2
MGKRSAGSIMWLASLAVVIACAGA

SEQ ID NO: 185 - protein, 56 aa, Tick-borne encephalitis virus
  Stem anchor sequence
KGSSIGRVFQKTKKGIERLTVIGEHAWDFGSAGGFLSSIGKAVHTVLGGAFNSIFG

SEQ ID NO: 186 - protein, 56 aa, Dengue virus
  Stem anchor sequence 1
KGSSIGKMFEATARGARRMAILGDTAWDFGSIGGVFTSVGKLVHQIFGTAYGVLFS

SEQ ID NO: 187 - protein, 56 aa, Dengue virus
  Stem anchor sequence 2
KGSSIGQMFETTMRGAKRMAILGDTAWDFGSLGGVFTSIGKALHQVFGAIYGAAFS

SEQ ID NO: 188 - protein, 56 aa, Japanese encephalitis virus
  Stem anchor sequence
AGSTLGKAFSTTLKGAQRLAALGDTAWDFGSIGGVFNSIGKAVHQVFGGAFRTLFG

SEQ ID NO: 189 - protein, 56 aa, St. Louis encephalitis virus
  Stem anchor sequence
EGSSIGKALATTWKGAQRLAVLGDTAWDFGSIGGVFNSIGKAVHQVFGGAFRTLFG

SEQ ID NO: 190 - protein, 56 aa, West Nile virus
  Stem anchor sequence
SGSSIGKAFTTTLKGAQRLAALGDTAWDFGSVGGVFTSVGKAVHQVFGGAFRSLFG

SEQ ID NO: 191 - protein, 56 aa, Yellow fever virus
  Encephalitis sequence
EGSSIGKLFTQTMKGAERLAVMGDAAWDFSSAGGFFTSVGKGIHTVFGSAFQGLFG

SEQ ID NO: 192 - DNA, 19075 bp, Artificial sequence
  pTM 2ATU MV Schw short
gcggccgctaatacgactcactatagggccaactttgtttggtctgatgagtccgtgaggacgaaacccggagtcccgggtcaccaaacaaagttgggtaaggatagttcaatcaatgatcatcttctagtgcacttaggattcaagatcctattatcagggacaagagcaggattagggatatccgagatggccacacttttaaggagcttagcattgttcaaaagaaacaaggacaaaccacccattacatcaggatccggtggagccatcagaggaatcaaacacattattatagtaccaatccctggagattcctcaattaccactcgatccagacttctggaccggttggtgaggttaattggaaacccggatgtgagcgggcccaaactaacaggggcactaataggtatattatccttatttgtggagtctccaggtcaattgattcagaggatcaccgatgaccctgacgttagcataaggctgttagaggttgtccagagtgaccagtcacaatctggccttaccttcgcatcaagaggtaccaacatggaggatgaggcggaccaatacttttcacatgatgatccaattagtagtgatcaatccaggttcggatggttcgggaacaaggaaatctcagatattgaagtgcaagaccctgagggattcaacatgattctgggtaccatcctagcccaaatttgggtcttgctcgcaaaggcggttacggccccagacacggcagctgattcggagctaagaaggtggataaagtacacccaacaaagaagggtagttggtgaatttagattggagagaaaatggttggatgtggtgaggaacaggattgccgaggacctctccttacgccgattcatggtcgctctaatcctggatatcaagagaacacccggaaacaaacccaggattgctgaaatgatatgtgacattgatacatatatcgtagaggcaggattagccagttttatcctgactattaagtttgggatagaaactatgtatcctgctcttggactgcatgaatttgctggtgagttatccacacttgagtccttgatgaacctttaccagcaaatgggggaaactgcaccctacatggtaatcctggagaactcaattcagaacaagttcagtgcaggatcataccctctgctctggagctatgccatgggagtaggagtggaacttgaaaactccatgggaggtttgaactttggccgatcttactttgatccagcatattttagattagggcaagagatggtaaggaggtcagctggaaaggtcagttccacattggcatctgaactcggtatcactgccgaggatgcaaggcttgtttcagagattgcaatgcatactactgaggacaagatcagtagagcggttggacccagacaagcccaagtatcatttctacacggtgatcaaagtgagaatgagctaccgagattggggggcaaggaagataggagggtcaaacagagtcgaggagaagccagggagagctacagagaaaccgggcccagcagagcaagtgatgcgagagctgcccatcttccaaccggcacacccctagacattgacactgcaacggagtccagccaagatccgcaggacagtcgaaggtcagctgacgccctgcttaggctgcaagccatggcaggaatctcggaagaacaaggctcagacacggacacccctatagtgtacaatgacagaaatcttctagactaggtgcgagaggccgagggccagaacaacatccgcctaccatccatcattgttataaaaaacttaggaaccaggtccacacagccgccagcccatcaaccatccactcccacgattggagccaatggcagaagagcaggcacgccatgtcaaaaacggactggaatgcatccgggctctcaaggccgagcccatcggctcactggccatcgaggaagctatggcagcatggtcagaaatatcagacaacccaggacaggagcgagccacctgcagggaagagaaggcaggcagttcgggtctcagcaaaccatgcctctcagcaattggatcaactgaaggcggtgcacctcgcatccgcggtcagggacctggagagagcgatgacgacgctgaaactttgggaatccccccaagaaatctccaggcatcaagcactgggttacagtgttattacgtttatgatcacagcggtgaagcggttaagggaatccaagatgctgactctatcatggttcaatcaggccttgatggtgatagcaccctctcaggaggagacaatgaatctgaaaacagcgatgtggatattggcgaacctgataccgagggatatgctatcactgaccggggatctgctcccatctctatggggttcagggcttctgatgttgaaactgcagaaggaggggagatccacgagctcctgagactccaatccagaggcaacaactttccgaagcttgggaaaactctcaatgttcctccgcccccggaccccggtagggccagcacttccgggacacccattaaaaagggcacagacgcgagattagcctcatttggaacggagatcgcgtctttattgacaggtggtgcaacccaatgtgctcgaaagtcaccctcggaaccatcagggccaggtgcacctgcggggaatgtccccgagtgtgtgagcaatgccgcactgatacaggagtggacacccgaatctggtaccacaatctccccgagatcccagaataatgaagaagggggagactattatgatgatgagctgttctctgatgtccaagatattaaaacagccttggccaaaatacacgaggataatcagaagataatctccaagctagaatcactgctgttattgaagggagaagttgagtcaattaagaagcagatcaacaggcaaaatatcagcatatccaccctggaaggacacctctcaagcatcatgatcgccattcctggacttgggaaggatcccaacgaccccactgcagatgtcgaaatcaatcccgacttgaaacccatcataggcagagattcaggccgagcactggccgaagttctcaagaaacccgttgccagccgacaactccaaggaatgacaaatggacggaccagttccagaggacagctgctgaaggaatttcagctaaagccgatcgggaaaaagatgagctcagccgtcgggtttgttcctgacaccggccctgcatcacgcagtgtaatccgctccattataaaatccagccggctagaggaggatcggaagcgttacctgatgactctccttgatgatatcaaaggagccaatgatcttgccaagttccaccagatgctgatgaagataataatgaagtagctacagctcaacttacctgccaaccccatgccagtcgacccaactagcctaccctccatcattgttataaaaaacttaggaaccaggtccacacagccgccagcccatcaacgcgtacggcgcgcagcgcttagacgtctcgcgatcgatactagtacaacctaaatccattataaaaaacttaggagcaaagtgattgcctcccaaggtccacaatgacagagacctacgacttcgacaagtcggcatgggacatcaaagggtcgatcgctccgatacaacccaccacctacagtgatggcaggctggtgccccaggtcagagtcatagatcctggtctaggcgacaggaaggatgaatgctttatgtacatgtttctgctgggggttgttgaggacagcgattccctagggcctccaatcgggcgagcatttgggttcctgcccttaggtgttggcagatccacagcaaagcccgaaaaactcctcaaagaggccactgagcttgacatagttgttagacgtacagcagggctcaatgaaaaactggtgttctacaacaacaccccactaactctcctcacaccttggagaaaggtcctaacaacagggagtgtcttcaacgcaaaccaagtgtgcaatgcggttaatctgataccgctcgataccccgcagaggttccgtgttgtttatatgagcatcacccgtctttcggataacgggtattacaccgttcctagaagaatgctggaattcagatcggtcaatgcagtggccttcaacctgctggtgacccttaggattgacaaggcgataggccctgggaagatcatcgacaatacagagcaacttcctgaggcaacatttatggtccacatcgggaacttcaggagaaagaagagtgaagtctactctgccgattattgcaaaatgaaaatcgaaaagatgggcctggtttttgcacttggtgggatagggggcaccagtcttcacattagaagcacaggcaaaatgagcaagactctccatgcacaactcgggttcaagaagaccttatgttacccgctgatggatatcaatgaagaccttaatcgattactctggaggagcagatgcaagatagtaagaatccaggcagttttgcagccatcagttcctcaagaattccgcatttacgacgacgtgatcataaatgatgaccaaggactattcaaagttctgtagaccgtagtgcccagcaatgcccgaaaacgacccccctcacaatgacagccagaaggcccggacaaaaaagccccctccgaaagactccacggaccaagcgagaggccagccagcagccgacggcaagcgcgaacaccaggcggccccagcacagaacagccctgacacaaggccaccaccagccaccccaatctgcatcctcctcgtgggacccccgaggaccaacccccaaggctgcccccgatccaaaccaccaaccgcatccccaccacccccgggaaagaaacccccagcaattggaaggcccctccccctcttcctcaacacaagaactccacaaccgaaccgcacaagcgaccgaggtgacccaaccgcaggcatccgactccctagacagatcctctctccccggcaaactaaacaaaacttagggccaaggaacatacacacccaacagaacccagaccccggcccacggcgccgcgcccccaacccccgacaaccagagggagcccccaaccaatcccgccggctcccccggtgcccacaggcagggacaccaacccccgaacagacccagcacccaaccatcgacaatccaagacgggggggcccccccaaaaaaaggcccccaggggccgacagccagcaccgcgaggaagcccacccaccccacacacgaccacggcaaccaaaccagaacccagaccaccctgggccaccagctcccagactcggccatcaccccgcagaaaggaaaggccacaacccgcgcaccccagccccgatccggcggggagccacccaacccgaaccagcacccaagagcgatccccgaaggacccccgaaccgcaaaggacatcagtatcccacagcctctccaagtcccccggtctcctcctcttctcgaagggaccaaaagatcaatccaccacacccgacgacactcaactccccacccctaaaggagacaccgggaatcccagaatcaagactcatccaatgtccatcatgggtctcaaggtgaacgtctctgccatattcatggcagtactgttaactctccaaacacccaccggtcaaatccattggggcaatctctctaagataggggtggtaggaataggaagtgcaagctacaaagttatgactcgttccagccatcaatcattagtcataaaattaatgcccaatataactctcctcaataactgcacgagggtagagattgcagaatacaggagactactgagaacagttttggaaccaattagagatgcacttaatgcaatgacccagaatataagaccggttcagagtgtagcttcaagtaggagacacaagagatttgcgggagtagtcctggcaggtgcggccctaggcgttgccacagctgctcagataacagccggcattgcacttcaccagtccatgctgaactctcaagccatcgacaatctgagagcgagcctggaaactactaatcaggcaattgagacaatcagacaagcagggcaggagatgatattggctgttcagggtgtccaagactacatcaataatgagctgataccgtctatgaaccaactatcttgtgatttaatcggccagaagctcgggctcaaattgctcagatactatacagaaatcctgtcattatttggccccagtttacgggaccccatatctgcggagatatctatccaggctttgagctatgcgcttggaggagacatcaataaggtgttagaaaagctcggatacagtggaggtgatttactgggcatcttagagagcggaggaataaaggcccggataactcacgtcgacacagagtcctacttcattgtcctcagtatagcctatccgacgctgtccgagattaagggggtgattgtccaccggctagagggggtctcgtacaacataggctctcaagagtggtataccactgtgcccaagtatgttgcaacccaagggtaccttatctcgaattttgatgagtcatcgtgtactttcatgccagaggggactgtgtgcagccaaaatgccttgtacccgatgagtcctctgctccaagaatgcctccgggggtacaccaagtcctgtgctcgtacactcgtatccgggtcttttgggaaccggttcattttatcacaagggaacctaatagccaattgtgcatcaatcctttgcaagtgttacacaacaggaacgatcattaatcaagaccctgacaagatcctaacatacattgctgccgatcactgcccggtagtcgaggtgaacggcgtgaccatccaagtcgggagcaggaggtatccagacgctgtgtacttgcacagaattgacctcggtcctcccatatcattggagaggttggacgtagggacaaatctggggaatgcaattgctaagttggaggatgccaaggaattgttggagtcatcggaccagatattgaggagtatgaaaggtttatcgagcactagcatagtctacatcctgattgcagtgtgtcttggagggttgatagggatccccgctttaatatgttgctgcagggggcgttgtaacaaaaagggagaacaagttggtatgtcaagaccaggcctaaagcctgatcttacgggaacatcaaaatcctatgtaaggtcgctctgatcctctacaactcttgaaacacaaatgtcccacaagtctcctcttcgtcatcaagcaaccaccgcacccagcatcaagcccacctgaaattatctccggcttccctctggccgaacaatatcggtagttaatcaaaacttagggtgcaagatcatccacaatgtcaccacaacgagaccggataaatgccttctacaaagataacccccatcccaagggaagtaggatagtcattaacagagaacatcttatgattgatagaccttatgttttgctggctgttctgtttgtcatgtttctgagcttgatcgggttgctagccattgcaggcattagacttcatcgggcagccatctacaccgcagagatccataaaagcctcagcaccaatctagatgtaactaactcaatcgagcatcaggtcaaggacgtgctgacaccactcttcaaaatcatcggtgatgaagtgggcctgaggacacctcagagattcactgacctagtgaaattaatctctgacaagattaaattccttaatccggatagggagtacgacttcagagatctcacttggtgtatcaacccgccagagagaatcaaattggattatgatcaatactgtgcagatgtggctgctgaagagctcatgaatgcattggtgaactcaactctactggagaccagaacaaccaatcagttcctagctgtctcaaagggaaactgctcagggcccactacaatcagaggtcaattctcaaacatgtcgctgtccctgttagacttgtatttaggtcgaggttacaatgtgtcatctatagtcactatgacatcccagggaatgtatgggggaacttacctagtggaaaagcctaatctgagcagcaaaaggtcagagttgtcacaactgagcatgtaccgagtgtttgaagtaggtgttatcagaaatccgggtttgggggctccggtgttccatatgacaaactatcttgagcaaccagtcagtaatgatctcagcaactgtatggtggctttgggggagctcaaactcgcagccctttgtcacggggaagattctatcacaattccctatcagggatcagggaaaggtgtcagcttccagctcgtcaagctaggtgtctggaaatccccaaccgacatgcaatcctgggtccccttatcaacggatgatccagtgatagacaggctttacctctcatctcacagaggtgttatcgctgacaatcaagcaaaatgggctgtcccgacaacacgaacagatgacaagttgcgaatggagacatgcttccaacaggcgtgtaagggtaaaatccaagcactctgcgagaatcccgagtgggcaccattgaaggataacaggattccttcatacggggtcttgtctgttgatctgagtctgacagttgagcttaaaatcaaaattgcttcgggattcgggccattgatcacacacggttcagggatggacctatacaaatccaaccacaacaatgtgtattggctgactatcccgccaatgaagaacctagccttaggtgtaatcaacacattggagtggataccgagattcaaggttagtccctacctcttcactgtcccaattaaggaagcaggcgaagactgccatgccccaacatacctacctgcggaggtggatggtgatgtcaaactcagttccaatctggtgattctacctggtcaagatctccaatatgttttggcaacctacgatacttccagggttgaacatgctgtggtttattacgtttacagcccaagccgctcattttcttacttttatccttttaggttgcctataaagggggtccccatcgaattacaagtggaatgcttcacatgggaccaaaaactctggtgccgtcacttctgtgtgcttgcggactcagaatctggtggacatatcactcactctgggatggtgggcatgggagtcagctgcacagtcacccgggaagatggaaccaatcgcagatagggctgctagtgaaccaatcacatgatgtcacccagacatcaggcatacccactagtgtgaaatagacatcagaattaagaaaaacgtagggtccaagtggttccccgttatggactcgctatctgtcaaccagatcttataccctgaagttcacctagatagcccgatagttaccaataagatagtagccatcctggagtatgctcgagtccctcacgcttacagcctggaggaccctacactgtgtcagaacatcaagcaccgcctaaaaaacggattttccaaccaaatgattataaacaatgtggaagttgggaatgtcatcaagtccaagcttaggagttatccggcccactctcatattccatatccaaattgtaatcaggatttatttaacatagaagacaaagagtcaacgaggaagatccgtgaactcctcaaaaaggggaattcgctgtactccaaagtcagtgataaggttttccaatgcttaagggacactaactcacggcttggcctaggctccgaattgagggaggacatcaaggagaaagttattaacttgggagtttacatgcacagctcccagtggtttgagccctttctgttttggtttacagtcaagactgagatgaggtcagtgattaaatcacaaacccatacttgccataggaggagacacacacctgtattcttcactggtagttcagttgagttgctaatctctcgtgaccttgttgctataatcagtaaagagtctcaacatgtatattacctgacatttgaactggttttgatgtattgtgatgtcatagaggggaggttaatgacagagaccgctatgactattgatgctaggtatacagagcttctaggaagagtcagatacatgtggaaactgatagatggtttcttccctgcactcgggaatccaacttatcaaattgtagccatgctggagcctctttcacttgcttacctgcagctgagggatataacagtagaactcagaggtgctttccttaaccactgctttactgaaatacatgatgttcttgaccaaaacgggttttctgatgaaggtacttatcatgagttaactgaagctctagattacattttcataactgatgacatacatctgacaggggagattttctcatttttcagaagtttcggccaccccagacttgaagcagtaacggctgctgaaaatgttaggaaatacatgaatcagcctaaagtcattgtgtatgagactctgatgaaaggtcatgccatattttgtggaatcataatcaacggctatcgtgacaggcacggaggcagttggccaccgctgaccctccccctgcatgctgcagacacaatccggaatgctcaagcttcaggtgaagggttaacacatgagcagtgcgttgataactggaaatcttttgctggagtgaaatttggctgctttatgcctcttagcctggatagtgatctgacaatgtacctaaaggacaaggcacttgctgctctccaaagggaatgggattcagtttacccgaaagagttcctgcgttacgaccctcccaagggaaccgggtcacggaggcttgtagatgttttccttaatgattcgagctttgacccatatgatgtgataatgtatgttgtaagtggagcttacctccatgaccctgagttcaacctgtcttacagcctgaaagaaaaggagatcaaggaaacaggtagactttttgctaaaatgacttacaaaatgagggcatgccaagtgattgctgaaaatctaatctcaaacgggattggcaaatattttaaggacaatgggatggccaaggatgagcacgatttgactaaggcactccacactctagctgtctcaggagtccccaaagatctcaaagaaagtcacaggggggggccagtcttaaaaacctactcccgaagcccagtccacacaagtaccaggaacgtgagagcagcaaaagggtttatagggttccctcaagtaattcggcaggaccaagacactgatcatccggagaatatggaagcttacgagacagtcagtgcatttatcacgactgatctcaagaagtactgccttaattggagatatgagaccatcagcttgtttgcacagaggctaaatgagatttacggattgccctcatttttccagtggctgcataagaggcttgagacctctgtcctgtatgtaagtgaccctcattgcccccccgaccttgacgcccatatcccgttatataaagtccccaatgatcaaatcttcattaagtaccctatgggaggtatagaagggtattgtcagaagctgtggaccatcagcaccattccctatctatacctggctgcttatgagagcggagtaaggattgcttcgttagtgcaaggggacaatcagaccatagccgtaacaaaaagggtacccagcacatggccctacaaccttaagaaacgggaagctgctagagtaactagagattactttgtaattcttaggcaaaggctacatgatattggccatcacctcaaggcaaatgagacaattgtttcatcacatttttttgtctattcaaaaggaatatattatgatgggctacttgtgtcccaatcactcaagagcatcgcaagatgtgtattctggtcagagactatagttgatgaaacaagggcagcatgcagtaatattgctacaacaatggctaaaagcatcgagagaggttatgaccgttaccttgcatattccctgaacgtcctaaaagtgatacagcaaattctgatctctcttggcttcacaatcaattcaaccatgacccgggatgtagtcatacccctcctcacaaacaacgacctcttaataaggatggcactgttgcccgctcctattggggggatgaattatctgaatatgagcaggctgtttgtcagaaacatcggtgatccagtaacatcatcaattgctgatctcaagagaatgattctcgcctcactaatgcctgaagagaccctccatcaagtaatgacacaacaaccgggggactcttcattcctagactgggctagcgacccttactcagcaaatcttgtatgtgtccagagcatcactagactcctcaagaacataactgcaaggtttgtcctgatccatagtccaaacccaatgttaaaaggattattccatgatgacagtaaagaagaggacgagggactggcggcattcctcatggacaggcatattatagtacctagggcagctcatgaaatcctggatcatagtgtcacaggggcaagagagtctattgcaggcatgctggataccacaaaaggcttgattcgagccagcatgaggaagggggggttaacctctcgagtgataaccagattgtccaattatgactatgaacaattcagagcagggatggtgctattgacaggaagaaagagaaatgtcctcattgacaaagagtcatgttcagtgcagctggcgagagctctaagaagccatatgtgggcgaggctagctcgaggacggcctatttacggccttgaggtccctgatgtactagaatctatgcgaggccaccttattcggcgtcatgagacatgtgtcatctgcgagtgtggatcagtcaactacggatggttttttgtcccctcgggttgccaactggatgatattgacaaggaaacatcatccttgagagtcccatatattggttctaccactgatgagagaacagacatgaagcttgccttcgtaagagccccaagtcgatccttgcgatctgctgttagaatagcaacagtgtactcatgggcttacggtgatgatgatagctcttggaacgaagcctggttgttggctaggcaaagggccaatgtgagcctggaggagctaagggtgatcactcccatctcaacttcgactaatttagcgcataggttgagggatcgtagcactcaagtgaaatactcaggtacatcccttgtccgagtggcgaggtataccacaatctccaacgacaatctctcatttgtcatatcagataagaaggttgatactaactttatataccaacaaggaatgcttctagggttgggtgttttagaaacattgtttcgactcgagaaagataccggatcatctaacacggtattacatcttcacgtcgaaacagattgttgcgtgatcccgatgatagatcatcccaggatacccagctcccgcaagctagagctgagggcagagctatgtaccaacccattgatatatgataatgcacctttaattgacagagatgcaacaaggctatacacccagagccataggaggcaccttgtggaatttgttacatggtccacaccccaactatatcacattttagctaagtccacagcactatctatgattgacctggtaacaaaatttgagaaggaccatatgaatgaaatttcagctctcataggggatgacgatatcaatagtttcataactgagtttctgctcatagagccaagattattcactatctacttgggccagtgtgcggccatcaattgggcatttgatgtacattatcatagaccatcagggaaatatcagatgggtgagctgttgtcatcgttcctttctagaatgagcaaaggagtgtttaaggtgcttgtcaatgctctaagccacccaaagatctacaagaaattctggcattgtggtattatagagcctatccatggtccttcacttgatgctcaaaacttgcacacaactgtgtgcaacatggtttacacatgctatatgacctacctcgacctgttgttgaatgaagagttagaagagttcacatttctcttgtgtgaaagcgacgaggatgtagtaccggacagattcgacaacatccaggcaaaacacttatgtgttctggcagatttgtactgtcaaccagggacctgcccaccaattcgaggtctaagaccggtagagaaatgtgcagttctaaccgaccatatcaaggcagaggctatgttatctccagcaggatcttcgtggaacataaatccaattattgtagaccattactcatgctctctgacttatctccggcgaggatcgatcaaacagataagattgagagttgatccaggattcattttcgacgccctcgctgaggtaaatgtcagtcagccaaagatcggcagcaacaacatctcaaatatgagcatcaaggctttcagacccccacacgatgatgttgcaaaattgctcaaagatatcaacacaagcaagcacaatcttcccatttcagggggcaatctcgccaattatgaaatccatgctttccgcagaatcgggttgaactcatctgcttgctacaaagctgttgagatatcaacattaattaggagatgccttgagccaggggaggacggcttgttcttgggtgagggatcgggttctatgttgatcacttataaagagatacttaaactaaacaagtgcttctataatagtggggtttccgccaattctagatctggtcaaagggaattagcaccctatccctccgaagttggccttgtcgaacacagaatgggagtaggtaatattgtcaaagtgctctttaacgggaggcccgaagtcacgtgggtaggcagtgtagattgcttcaatttcatagttagtaatatccctacctctagtgtggggtttatccattcagatatagagaccttgcctgacaaagatactatagagaagctagaggaattggcagccatcttatcgatggctctgctcctgggcaaaataggatcaatactggtgattaagcttatgcctttcagcggggattttgttcagggatttataagttatgtagggtctcattatagagaagtgaaccttgtataccctagatacagcaacttcatctctactgaatcttatttggttatgacagatctcaaggctaaccggctaatgaatcctgaaaagattaagcagcagataattgaatcatctgtgaggacttcacctggacttataggtcacatcctatccattaagcaactaagctgcatacaagcaattgtgggagacgcagttagtagaggtgatatcaatcctactctgaaaaaacttacacctatagagcaggtgctgatcaattgcgggttggcaattaacggacctaagctgtgcaaagaattgatccaccatgatgttgcctcagggcaagatggattgcttaattctatactcatcctctacagggagttggcaagattcaaagacaaccaaagaagtcaacaagggatgttccacgcttaccccgtattggtaagtagcaggcaacgagaacttatatctaggatcacccgcaaattctgggggcacattcttctttactccgggaacaaaaagttgataaataagtttatccagaatctcaagtccggctatctgatactagacttacaccagaatatcttcgttaagaatctatccaagtcagagaaacagattattatgacggggggtttgaaacgtgagtgggtttttaaggtaacagtcaaggagaccaaagaatggtataagttagtcggatacagtgccctgattaaggactaattggttgaactccggaaccctaatcctgccctaggtggttaggcattatttgcaatatattaaagaaaactttgaaaatacgaagtttctattcccagctttgtctggtggccggcatggtcccagcctcctcgctggcgccggctgggcaacattccgaggggaccgtcccctcggtaatggcgaatgggacgcggccgatccggctgctaacaaagcccgaaaggaagctgagttggctgctgccaccgctgagcaataactagcataaccccttggggcctctaaacgggtcttgaggggttttttgctgaaaggaggaactatatccggatgcggccgcgggccctatggtacccagcttttgttccctttagtgagggttaattccgagcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctcggcccccctgacgagcatcacaaaaatcgacgctcaagtcagaggtggcgaaacccgacaggactataaagataccaggcgttcccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactgcccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgaaaaaaagcggttagctccttcggtcctccgatcgttgtcagaagtaagttggccgcagtgttatcactcatgcttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagccaccgcggtg

The invention claimed is:

1. An infectious replicative virus particle comprising a measles virus vector backbone and a Zika virus E-protein, wherein the infectious replicative virus particle comprises in its genome at least two nucleic acid sequences, wherein (i) the first nucleic acid sequence encodes at least one E-protein of a Zika virus; and (ii) the second nucleic acid sequence encodes the measles virus vector backbone; wherein:
    (a) the first nucleic acid sequence is operably linked to the second nucleic acid sequence;
    (b) the first nucleic acid sequence comprises, in sequential order:
        (1) a nucleic acid sequence encoding a capsid cleavage site, the capsid cleavage site comprising the residues arginine-arginine immediately preceding the nucleic acid sequence of (2) below;
        (2) a nucleic acid sequence encoding at least one pre-membrane protein signal sequence;
        (3) a nucleic acid sequence encoding a pre-membrane protein of a flavivirus;
        (4) a nucleic acid sequence encoding an E-protein signal sequence; and
        (5) a nucleic acid sequence encoding the at least one E-protein of a Zika virus, the nucleic acid sequence encoding at least one E-protein of a Zika virus having at least 75% sequence identity to the E-protein portion encoded by any one of SEQ ID NOs: 1 to 13 and 67 to 87, wherein
            (5a) the nucleic acid sequence encoding the at least one E-protein of a Zika virus does not comprise a sequence encoding a stem-anchor region; or
            (5b) the nucleic acid sequence encoding the at least one E-protein of a Zika virus encodes a mutation at amino acid position 107 in comparison to the sequence of any one of SEQ ID NOs:40 to 52 and 130 to 150, and does not comprise a sequence encoding a stem-anchor region; or
            (5c) the nucleic acid sequence encoding the at least one E-protein of a Zika virus encodes a mutation at position 107 in comparison to the sequence of any one of SEQ ID NOs:40 to 52 or 130 to 150, and comprises a sequence encoding a stem-anchor region of an E-protein of a Zika virus, or a heterologous stem-anchor region; and
    (c) the infectious replicative virus particle does not comprise a nucleic acid sequence encoding a C-protein or a non-structural protein of a flavivirus.

2. The infectious replicative virus particle according to claim 1, wherein the first nucleic acid sequence comprises a nucleic acid sequence, or encodes an amino acid sequence, as set forth in any one of SEQ ID NOs: 27 to 39, 53 to 58, 61 to 66, 109 to 129, 151 and 152, or a sequence having at least 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% sequence identity thereto, wherein the nucleic acid molecule encodes at least one Zika virus antigen.

3. An immunogenic composition comprising an infectious replicative virus particle according to claim 1 and at least one pharmaceutically and/or veterinarily acceptable carrier and/or excipient.

4. An isolated host cell comprising an infectious replicative virus particle according to claim 1.

5. A method of inducing an immune response against a Zika virus in a subject, comprising administering the immunogenic composition according to claim 3 to the subject.

6. The method according to claim 5, wherein the immunogenic composition is characterized by a content of contaminating host cell DNA of less than 100 pg/dosis, less than 75 pg/dosis, less than 50 pg/dosis, less than 25 pg/dosis, or less than 10 pg/dosis, wherein one dosis represents one dose comprising the immunogenic composition to be administered to a subject in need thereof as a single dose.

7. The infectious replicative virus particle according to claim 1, wherein the nucleic acid sequence encoding at least one pre-membrane protein of a Zika virus has at least 75% sequence identity to the pre-membrane protein portion as encoded by any one of SEQ ID NOs: 1 to 13 and 67 to 87.

8. The infectious replicative virus particle according to claim 7, wherein the first nucleic acid sequence comprises a sequence selected from the group consisting of SEQ ID NOs: 53 to 56, or a sequence having at least 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% sequence identity thereto.

9. The infectious replicative virus particle according to claim 7, wherein the first and second nucleic acid sequences together comprise a nucleic acid sequence as set forth in SEQ ID NO: 60 or 192 and a sequence encoding an amino acid sequence of SEQ ID NOs: 27 to 39, 40 to 52, 109 to 129 or 130 to 150 inserted between a BsiWI and a BssHII restriction site of SEQ ID NO:60 or of SEQ ID NO:192, or a sequence having at least 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% sequence identity thereto.

10. The infectious replicative virus particle according to claim 1, wherein the first nucleic acid sequence comprises a Kozak sequence, wherein the Kozak sequence comprises the additional nucleic acid sequences gca after the start codon of the first nucleic acid sequence encoding the Zika virus E-protein.

11. The infectious replicative virus particle according to claim 1, wherein the second nucleic acid sequence comprises a sequence according to SEQ ID NO: 59, 60 or 192.

12. The infectious replicative virus particle according to claim 1, wherein the mutation at amino acid position 107 in (5b) is L107D.

13. The infectious replicative virus particle according to claim 1, wherein the mutation at amino acid position 107 in (5c) is L107D.

14. The infectious replicative virus particle according to claim 1, wherein the at least one pre-membrane protein signal sequence of (b)(2) is from a flavivirus.

15. The infectious replicative virus particle according to claim 1, wherein the at least one pre-membrane protein signal sequence of (b)(2) is from a Zika virus.

16. The infectious replicative virus particle according to claim 1, wherein the pre-membrane protein of (b)(3) is from a Zika virus.

17. The infectious replicative virus particle according to claim 1, wherein the E-protein signal sequence of (b)(4) is from a flavivirus.

18. The infectious replicative virus particle according to claim 1, wherein the E-protein signal sequence of (b)(4) is from a Zika virus.

19. The infectious replicative virus particle according to claim 1, wherein the nucleic acid sequence encoding an E-protein signal sequence comprises the E-protein signal sequence portion encoded by any one of SEQ ID NOs: 1 to 13 and 67 to 87.

20. The infectious replicative virus particle according to claim 1, wherein the measles virus vector backbone is derived from an attenuated measles virus strain.

21. The infectious replicative virus particle according to claim 20, wherein the attenuated measles virus strain is selected from the group consisting of the Schwarz strain, the Zagreb strain, the AIK-C strain and the Moraten strain.

22. An infectious replicative virus particle comprising a measles virus vector backbone from one of the Schwarz strain, the Zagreb strain, the AIK-C strain and the Moraten strain, and a Zika virus E-protein, wherein the infectious replicative virus particle comprises in its genome at least two nucleic acid sequences, wherein (i) the first nucleic acid sequence encodes at least one E-protein of a Zika virus; and (ii) the second nucleic acid sequence encodes the measles virus vector backbone; wherein:
 (a) the first nucleic acid sequence is operably linked to the second nucleic acid sequence;
 (b) the first nucleic acid sequence comprises, in sequential order:
  (1) a nucleic acid sequence encoding a capsid cleavage site, the capsid cleavage site comprising the residues arginine-arginine immediately preceding the nucleic acid sequence of (2) below;
  (2) a nucleic acid sequence encoding at least one pre-membrane protein signal sequence of a Zika virus pre-membrane protein;
  (3) a nucleic acid sequence encoding a pre-membrane protein of a Zika virus;
  (4) a nucleic acid sequence encoding an E-protein signal sequence of a Zika virus; and
  (5) a nucleic acid sequence encoding the at least one E-protein of a Zika virus, the nucleic acid sequence encoding at least one E-protein of a Zika virus comprising the E-protein portion encoded by any one of SEQ ID NOs: 1 to 13 and 67 to 87, wherein the nucleic acid sequence encoding the at least one E-protein of a Zika virus does not comprise a sequence encoding a stem-anchor region, and wherein the nucleic acid sequence encoding the at least one E-protein of a Zika virus encodes a mutation L107D in comparison to the sequence of any one of SEQ ID NOs:40 to 52 or 130 to 150; and
 (c) the infectious replicative virus particle does not comprise a nucleic acid sequence encoding a C-protein or a non-structural protein of a flavivirus.

23. An infectious replicative virus particle comprising a measles virus vector backbone from one of the Schwarz strain, the Zagreb strain, the AIK-C strain and the Moraten strain, and a Zika virus E-protein, wherein the infectious replicative virus particle comprises in its genome at least two nucleic acid sequences, wherein (i) the first nucleic acid sequence encodes at least one E-protein of a Zika virus; and (ii) the second nucleic acid sequence encodes the measles virus vector backbone; wherein:
 (a) the first nucleic acid sequence is operably linked to the second nucleic acid sequence;
 (b) the first nucleic acid sequence comprises, in sequential order:
  (1) a nucleic acid sequence encoding a capsid cleavage site, the capsid cleavage site comprising the residues arginine-arginine immediately preceding the nucleic acid sequence of (2) below;
  (2) a nucleic acid sequence encoding at least one pre-membrane protein signal sequence of a Zika virus pre-membrane protein;
  (3) a nucleic acid sequence encoding a pre-membrane protein of a Zika virus;
  (4) a nucleic acid sequence encoding an E-protein signal sequence of a Zika virus; and
  (5) a nucleic acid sequence encoding the at least one E-protein of a Zika virus, the nucleic acid sequence encoding at least one E-protein of a Zika virus comprising the E-protein portion encoded by any one of SEQ ID NOs: 1 to 13 and 67 to 87, wherein the nucleic acid sequence encoding the at least one E-protein of a Zika virus does not comprise a sequence encoding a stem-anchor region; and
 (c) the infectious replicative virus particle does not comprise a nucleic acid sequence encoding a C-protein or a non-structural protein of a flavivirus.

24. An infectious replicative virus particle comprising a measles virus vector backbone from one of the Schwarz strain, the Zagreb strain, the AIK-C strain and the Moraten strain, and a Zika virus E-protein, wherein the infectious replicative virus particle comprises in its genome at least two nucleic acid sequences, wherein (i) the first nucleic acid sequence encodes at least one E-protein of a Zika virus; and (ii) the second nucleic acid sequence encodes the measles virus vector backbone; wherein:
 (a) the first nucleic acid sequence is operably linked to the second nucleic acid sequence;
 (b) the first nucleic acid sequence comprises, in sequential order:
  (1) a nucleic acid sequence encoding a capsid cleavage site, the capsid cleavage site comprising the residues arginine-arginine immediately preceding the nucleic acid sequence of (2) below;
  (2) a nucleic acid sequence encoding at least one pre-membrane protein signal sequence of a Zika virus pre-membrane protein;
  (3) a nucleic acid sequence encoding a pre-membrane protein of a Zika virus;
  (4) a nucleic acid sequence encoding an E-protein signal sequence of a Zika virus; and
  (5) a nucleic acid sequence encoding the at least one E-protein of a Zika virus, the nucleic acid sequence encoding at least one E-protein of a Zika virus comprising the E-protein portion encoded by any one of SEQ ID NOs: 1 to 13 and 67 to 87, wherein the nucleic acid sequence encoding the at least one E-protein of a Zika virus comprises a sequence encoding a stem-anchor region of an E-protein of a Zika virus, or a heterologous stem-anchor region, and wherein the nucleic acid sequence encoding the at least one E-protein of a Zika virus encodes a mutation L107D in comparison to the sequence of any one of SEQ ID NOs:40 to 52 or 130 to 150; and
 (c) the infectious replicative virus particle does not comprise a nucleic acid sequence encoding a C-protein or a non-structural protein of a flavivirus.

25. An infectious replicative virus particle comprising a measles virus vector backbone from one of the Schwarz strain, the Zagreb strain, the AIK-C strain and the Moraten strain, and a Zika virus E-protein, wherein the infectious replicative virus particle comprises in its genome at least two nucleic acid sequences, wherein (i) the first nucleic acid sequence encodes at least one E-protein of a Zika virus; and (ii) the second nucleic acid sequence encodes the measles virus vector backbone; wherein:
 (a) the first nucleic acid sequence is operably linked to the second nucleic acid sequence;

(b) the first nucleic acid sequence comprises, in sequential order:
  (1) a nucleic acid sequence encoding a capsid cleavage site, the capsid cleavage site comprising the residues arginine-arginine immediately preceding the nucleic acid sequence of (2) below;
  (2) a nucleic acid sequence encoding at least one pre-membrane protein signal sequence of a Zika virus pre-membrane protein;
  (3) a nucleic acid sequence encoding a pre-membrane protein of a Zika virus;
  (4) a nucleic acid sequence encoding an E-protein signal sequence of a Zika virus; and
  (5) a nucleic acid sequence encoding the at least one E-protein of a Zika virus, the nucleic acid sequence encoding at least one E-protein of a Zika virus comprising the E-protein portion encoded by any one of SEQ ID NOs: 1 to 13 and 67 to 87, wherein the nucleic acid sequence encoding the at least one E-protein of a Zika virus comprises a sequence encoding a stem-anchor region of an E-protein of a Zika virus, or a heterologous stem-anchor region; and
(c) the infectious replicative virus particle does not comprise a nucleic acid sequence encoding a C-protein or a non-structural protein of a flavivirus.

* * * * *